(12) United States Patent
Gomez et al.

(10) Patent No.: US 11,034,962 B2
(45) Date of Patent: Jun. 15, 2021

(54) INHIBITORS OF CACNA1A/ALPHA1A SUBUNIT INTERNAL RIBOSOMAL ENTRY SITE (IRES) AND METHODS OF TREATING SPINOCEREBELLAR ATAXIA TYPE 6

(71) Applicant: THE UNIVERSITY OF CHICAGO, Chicago, IL (US)

(72) Inventors: Christopher M. Gomez, Chicago, IL (US); Yu Miyazaki, Chicago, IL (US); Xiaofei Du, Chicago, IL (US)

(73) Assignee: THE UNIVERSITY OF CHICAGO, Chicago, IL (US)

( * ) Notice: Subject to any disclaimer, the term of this patent is extended or adjusted under 35 U.S.C. 154(b) by 0 days.

(21) Appl. No.: 16/450,760

(22) Filed: Jun. 24, 2019

(65) Prior Publication Data
US 2020/0063142 A1   Feb. 27, 2020

Related U.S. Application Data

(62) Division of application No. 15/743,560, filed as application No. PCT/US2016/045492 on Aug. 4, 2016, now abandoned.

(60) Provisional application No. 62/200,933, filed on Aug. 4, 2015.

(51) Int. Cl.
  *C12N 15/113* (2010.01)
  *A61P 25/28* (2006.01)
  *C12N 15/86* (2006.01)

(52) U.S. Cl.
  CPC .......... *C12N 15/1138* (2013.01); *A61P 25/28* (2018.01); *C12N 15/86* (2013.01); *C12N 2310/141* (2013.01); *C12N 2330/50* (2013.01); *C12N 2750/14143* (2013.01); *C12N 2750/14171* (2013.01)

(58) Field of Classification Search
  CPC ...................... C12N 15/1138; C12N 2310/141
  See application file for complete search history.

(56) References Cited

U.S. PATENT DOCUMENTS

| 4,450,150 | A | 5/1984 | Sidman |
| 7,399,845 | B2 | 7/2008 | Seth et al. |
| 7,427,672 | B2 | 9/2008 | Imanishi et al. |
| 10,017,765 | B2 | 7/2018 | Gomez et al. |
| 2004/0171570 | A1 | 9/2004 | Allerson et al. |
| 2011/0082093 | A1 | 4/2011 | Gregory et al. |
| 2012/0302626 | A1 | 11/2012 | Dave et al. |
| 2013/0225652 | A1 | 8/2013 | Chorn et al. |
| 2018/0201937 | A1 | 7/2018 | Gomez et al. |

FOREIGN PATENT DOCUMENTS

| WO | WO-1994/023699 A1 | 10/1994 |
| WO | WO-1998/018811 A1 | 5/1998 |
| WO | WO-1999/040942 A1 | 8/1999 |
| WO | WO-2000/032218 A1 | 6/2000 |
| WO | WO-2004/033036 A2 | 4/2004 |
| WO | WO-2005/072703 A2 | 8/2005 |
| WO | WO-2007/081204 A2 | 7/2007 |
| WO | WO-2007/133747 A2 | 11/2007 |
| WO | WO-2007/141411 A1 | 12/2007 |
| WO | WO-2008/130158 A1 | 10/2008 |
| WO | WO-2008/150729 A2 | 12/2008 |
| WO | WO-2008/154401 A2 | 12/2008 |
| WO | WO-2009/006478 A2 | 1/2009 |
| WO | WO-2010/085665 A2 | 7/2010 |
| WO | WO-2014/071078 A1 | 5/2014 |
| WO | WO-2014/100252 A1 | 6/2014 |
| WO | WO-2014/167074 A1 | 10/2014 |
| WO | WO-2015/070083 A1 | 5/2015 |
| WO | WO-2015/089351 A1 | 6/2015 |

OTHER PUBLICATIONS

Adeli, Translational control mechanisms in metabolic regulation: critical role of RNA binding proteins, microRNAs, and cytoplasmic RNA granules, Am. J. Physiol. Endocrinol. Metab., 301(6):E1051-64 (2011).
Adjei et al., Pulmonary delivery of peptide drugs: effect of particle size on bioavailability of leuprolide acetate in healthy male volunteers, Pharm. Res., 7(6):565-9 (1990).
Akao et al., Role of anti-oncomirs miR-143 and -145 in human colorectal tumors, Cancer Gene Ther., 17(6):398-408 (2010).
Asgari, Role of microRNAs in arbovirus/vector interactions, Viruses, 6(9):3514-34 (2014).
Babar et al., Nanoparticle-based therapy in an in vivo microRNA-155 (miR-155)-dependent mouse model of lymphoma, Proc. Natl. Acad. Sci. USA, 109(26):E1695-704 (2012).
Basri et al., Cambodian founder effect for spinocerebellar ataxia type 3 (Machado-Joseph disease), 52(10):848-55 (2007).
Bauer et al., The pathogenic mechanisms of polyglutamine diseases and current therapeutic strategies, J. Neurochem., 110(6):1737-65 (2009).
Bernstein et al., Role for a bidentate ribonuclease in the initiation step of Rna interference, Nature, 409(6818):363-6 (2001).
Borel et al., Recombinant AAV as a platform for translating the therapeutic potential of RNA interference, Mol. Ther., 22(4):692-701 (2014).
Burnett et al., RNA-based therapeutics: current progress and future prospects, Chem. Biol., 19(1):60-71 (2012).
Busk, A tool for design of primers for microRNA-specific quantitative RT-qPCR, BMC Bioinformatics, 15:29 (2014).
Cain et al., Voltage-gated calcium channels and disease, Biofactors, 37(3):197-205 (2011).
Caplen et al., dsRNA-mediated gene silencing in cultured *Drosophila* cells: a tissue culture model for the analysis of RNA interference, Gene, 252(1-2):95-105 (2000).
Chen et al., Altered frequency-dependent inactivation and steady-state inactivation of polyglutamine-expanded alpha1A in SCA6, Am. J. Physiol. Cell Physiol., 292(3):C1078-86 (2007).

(Continued)

*Primary Examiner* — Brian Whiteman
(74) *Attorney, Agent, or Firm* — Marshall, Gerstein & Borun LLP

(57) ABSTRACT

The invention provides methods of treating polyglutamine diseases, e.g., spinocerebellar ataxia Type 6, in a subject, comprising administering to the subject an IRES inhibitor in an amount effective for treating the SCA6 in the subject. Also provided herein are the IRES inhibitors, and pharmaceutical compositions comprising the same.

11 Claims, 35 Drawing Sheets

Specification includes a Sequence Listing.

(56) References Cited

OTHER PUBLICATIONS

Chen et al., Gene therapy for cardiovascular disease mediated by ultrasound and microbubbles, Cardiovasc. Ultrasound, 11:11 (2013).
Chen et al., Nanoparticles modified with tumor-targeting scFv deliver siRNA and miRNA for cancer therapy, Mol. Ther., 18(9):1650-6 (2010).
Cheng et al., Polymer nanoparticle-mediated delivery of microRNA inhibition and alternative splicing, Mol. Pharm., 9(5):1481-8 (2012).
Chiou et al., Cationic polyurethanes-short branch PEI-mediated delivery of Mir145 inhibited epithelial-mesenchymal transdifferentiation and cancer stem-like properties and in lung adenocarcinoma, J. Control. Release, 159(2):240-50 (2012).
Chistiakov et al., Strategies to deliver microRNAs as potential therapeutics in the treatment of cardiovascular pathology, Drug Deliv., 19(8):392-405 (2012).
Craig et al., Molecular epidemiology of spinocerebellar ataxia type 6, Ann. Neurol., 55(5):752-5 (2004).
Craig et al., Systemic microRNA-34a delivery induces apoptosis and abrogates growth of diffuse large B-cell lymphoma in vivo, Leukemia, 26(11):2421-4 (2012).
Dasgupta et al., Targeting internal ribosome entry site (IRES)-mediated translation to block hepatitis C and other RNA viruses, FEMS Microbiol. Lett., 234(2):189-99 (2004).
Davidson et al., Current prospects for RNA interference-based therapies, Nat. Rev. Genet., 12(5):329-40 (2011).
Davis et al., Therapeutic targeting of HCV internal ribosomal entry site RNA, Antivir. Chem. Chemother., 21(3):117-28 (2011).
De Breyne et al., Direct functional interaction of initiation factor eIF4G with type 1 internal ribosomal entry sites, Proc. Natl. Acad. Sci. USA, 106(23):9197-202 (2009).
Dias et al., Antisense oligonucleotides: basic concepts and mechanisms, Mol. Cancer Ther., 1(5):347-55 (2002).
Du et al., Second cistron in CACNA1A gene encodes a transcription factor mediating cerebellar development and SCA6, Cell, 154(1):118-33 (2013).
Durr, Autosomal dominant cerebellar ataxias: polyglutamine expansions and beyond, Lancet Neurol., 9(9):885-94 (2010).
Elbashir et al., Duplexes of 21-nucleotide RNAs mediate RNA interference in cultured mammalian cells, Nature, 411(6836):494-8 (2001).
Elbashir et al., RNA interference is mediated by 21- and 22-nucleotide RNAs, Genes Dev., 15(2):188-200 (2001).
Ewing et al., Large-scale mapping of human protein-protein interactions by mass spectrometry, Mol. Syst. Biol., 3:89 (2007).
Fire et al., Potent and specific genetic interference by double-stranded RNA in Caenorhabditis elegans, Nature, 391(6669):806-11 (1998).
Fukao et al., MicroRNAs trigger dissociation of eIF4AI and eIF4AII from target mRNAs in humans, Mol. Cell, 56(1):79-89 (2014).
Fukaya et al., MicroRNAs block assembly of eIF4F translation initiation complex in Drosophila, Mol. Cell, 56(1):67-78 (2014).
Gasparian et al., Inhibition of encephalomyocarditis virus and poliovirus replication by quinacrine: implications for the design and discovery of novel antiviral drugs, J. Virol., 84(18):9390-7 (2010).
Gennarino et al., Pumilio1 haploinsufficiency leads to SCA1-like neurodegeneration by increasing wild-type Ataxin1 levels, Cell, 160(6):1087-98 (2015).
Geschwind et al., Spinocerebellar ataxia type 6. Frequency of the mutation and genotype-phenotype correlations, Neurology, 49(5):1247-51 (1997).
Gomez et al., Spinocerebellar ataxia type 6: gaze-evoked and vertical nystagmus, Purkinje cell degeneration, and variable age of onset, Ann. Neurol., 42(6):933-50 (1997).
Gradi et al., A novel functional human eukaryotic translation initiation factor 4G, Mol. Cell Biol., 18(1):334-42 (1998).
Gu et al., Slicing-independent RISC activation requires the argonaute PAZ domain, Curr. Biol., 22(16):1536-42 (2012).

Hagiwara et al., A paradigm shift for extracellular vesicles as small RNA carriers: from cellular waste elimination to therapeutic applications, Drug Deliv. Transl. Res., 4(1):31-7 (2014).
Hammond et al., An RNA-directed nuclease mediates post-transcriptional gene silencing in Drosophila cells, Nature, 404(6775):293-6 (2000).
Hanson et al., IRES-Dependent Translational Control during Virus-Induced Endoplasmic Reticulum Stress and Apoptosis, Front Microbiol., 3:92 (2012).
Hauptmann et al., Generation of catalytic human Ago4 identifies structural elements important for RNA cleavage, RNA, 20(10):1532-8 (2014).
Havel et al. Nuclear accumulation of polyglutamine disease proteins and neuropathology, Mol. Brain, 2:21 (2009).
Havugimana et al., A census of human soluble protein complexes, Cell, 150(5):1068-81 (2012).
He et al., Current understanding on the pathogenesis of polyglutamine diseases, Neurosci. Bull., 26(3):247-56 (2010).
Hutvagner et al., RNAi: nature abhors a double-strand, Curr. Opin. Genet. Dev., 12(2):225-32 (2002).
Ibrahim et al., MicroRNA replacement therapy for miR-145 and miR-33a is efficacious in a model of colon carcinoma, Cancer Res., 71(15):5214-24 (2011).
Iida et al., Systemic delivery of tyrosine-mutant AAV vectors results in robust transduction of neurons in adult mice, Biomed. Res. Int., 2013:974819 (2013).
Ikeuchi et al., Spinocerebellar ataxia type 6: CAG repeat expansion in alpha1A voltage-dependent calcium channel gene and clinical variations in Japanese population, Ann. Neurol., 42(6):879-84 (1997).
International Application No. PCT/US2016/045492, International Search Report and Written Opinion, dated Oct. 28, 2016.
Ishiguro et al., The carboxy-terminal fragment of alpha(1A) calcium channel preferentially aggregates in the cytoplasm of human spinocerebellar ataxia type 6 Purkinje cells, Acta Neuropathol., 119(4):447-64 (2010).
Jackson et al., The mechanism of eukaryotic translation initiation and principles of its regulation, Nat. Rev. Mol. Cell Biol., 11(2):113-27 (2010).
Jayadev et al., Cambodian founder effect for spinocerebellar ataxia type 3 (Machado-Joseph disease), J. Neurol. Sci., 250(1-2):110-3 (2006).
Jen et al., Clinical spectrum of episodic ataxia type 2, Neurology, 62(1):17-22 (2004).
Jopling et al., L-Myc protein synthesis is initiated by internal ribosome entry, RNA, 10(2):287-98 (2004).
Juliano et al., Receptors, endocytosis, and trafficking: the biological basis of targeted delivery of antisense and siRNA oligonucleotides, J. Drug Target, 21(1):27-43 (2013).
Jun et al., Ablation of P/Q-type Ca(2+) channel currents, altered synaptic transmission, and progressive ataxia in mice lacking the alpha(1A)-subunit, Proc. Natl. Acad. Sci. USA, 96(26):15245-50 (1999).
Juvvuna et al., Argonaute identity defines the length of mature mammalian microRNAs, Nucleic Acids Res., 40(14):6808-20 (2012).
Karaa et al., The VEGF IRESes are differentially susceptible to translation inhibition by miR-16, RNA, 15(2):249-54 (2009).
Kawashima et al., Pulmonary delivery of insulin with nebulized DL-lactide/glycolide copolymer (PLGA) nanospheres to prolong hypoglycemic effect, J. Control. Release, 61(1-2):279-87 (1999).
Kay et al., Viral vectors for gene therapy: the art of turning infectious agents into vehicles of therapeutics, Nat. Med., 7(1):33-40 (2001).
KHatri et al., In vivo delivery aspects of miRNA, shRNA and siRNA, Crit. Rev. Ther. Drug Carrier Syst., 29(6):487-527 (2012).
Kim et al., Biogenesis of small RNAs in animals, Nat. Rev. Mol. Cell Biol., 10(2):126-39 (2009).
Klockgether, The clinical diagnosis of autosomal dominant spinocerebellar ataxias, Cerebellum, 7(2):101-5 (2008).
Klockgether, Update on degenerative ataxis, Curr. Opin. Neurol., 24(4):339-45 (2011).
Koeppen, The hereditary ataxias, J. Neuropathol. Exp. Neurol., 57(6):531-43 (1998).

(56) References Cited

OTHER PUBLICATIONS

Kole et al., RNA therapeutics: beyond RNA interference and antisense oligonucleotides, Nat. Rev. Drug Discov., 11(2):125-40 (2012).
Kordasiewicz et al., C-termini of P/Q-type Ca2+ channel alpha1A subunits translocate to nuclei and promote polyglutamine-mediated toxicity, Hum. Mol. Genet., 15(10):1587-99 (2006).
Kordasiewicz et al., Molecular pathogenesis of spinocerebellar ataxia type 6, Neurotherapeutics, 4(2):285-94 (2007).
Kubodera et al., Proteolytic cleavage and cellular toxicity of the human alpha1A calcium channel in spinocerebellar ataxia type 6, Neurosci Lett., 341(1):74-8 (2003).
Kumar et al., miRNA_Targets: a database for miRNA target predictions in coding and non-coding regions of mRNAs, Genomics, 100(6):352-6 (2012).
Kurtzke, Epidemiology of amyotrophic lateral sclerosis, Adv. Neurol., 36:281-302 (1982).
La Spada et al., Repeat expansion disease: progress and puzzles in disease pathogenesis, Nat. Rev. Genet., 11(4):247-58 (2010).
Li et al., Single-chain antibody-mediated gene delivery into ErbB2-positive human breast cancer cells, Cancer Gene Ther., 8(8):555-65 (2001).
Lian et al., The C-terminal half of human Ago2 binds to multiple GW-rich regions of GW182 and requires GW182 to mediate silencing, RNA, 15(5):804-13 (2009).
Liu et al., Argonaute2 is the catalytic engine of mammalian RNAi, Science, 305(5689):1437-41 (2004).
Liu et al., miRNA cassettes in viral vectors: problems and solutions, Biochim. Biophys. Acta, 1809(11-12):732-45 (2011).
Liu et al., Pulmonary delivery of free and liposomal insulin, Pharm. Res., 10(2):228-32 (1993).
Liu et al., Targeted delivery of antisense inhibitor of miRNA for antiangiogenesis therapy using cRGD-functionalized nanoparticles, Mol. Pharm., 8(1):250-9 (2011).
Lopez-Bastida et al., Social economic costs and health-related quality of life in patients with degenerative cerebellar ataxia in Spain, Mov. Disord., 23(2):212-7 (2008).
Lory et al., Calcium channelopathies in inherited neurological disorders: relevance to drug screening for acquired channel disorders, IDrugs, 13(7):467-71 (2010).
Lytle et al., Target mRNAs are repressed as efficiently by microRNA-binding sites in the 5' UTR as in the 3' UTR, Proc. Natl. Acad. Sci. USA, 104(23):9667-72 (2007).
Marelli et al., Autosomal dominant cerebellar ataxias, Rev. Neurol. (Paris):167(5):385-400 (2011).
Marqueze-Pouey et al., Toxicity and endocytosis of spinocerebellar ataxia type 6 polyglutamine domains: role of myosin IIb, Traffic, 9(7):1088-100 (2008).
Matsumura et al., Spinocerebellar ataxia type 6. Molecular and clinical features of 35 Japanese patients including one homozygous for the CAG repeat expansion, Neurology, 49(5):1238-43 (1997).
Matsuyama et al., Direct alteration of the P/Q-type Ca2+ channel property by polyglutamine expansion in spinocerebellar ataxia 6, J. Neurosci., 19(12):RC14 (1999).
Matsuyama et al., Molecular features of the CAG repeats of spinocerebellar ataxia 6 (SCA6), Hum. Mol. Genet., 6(8):1283-7 (1997).
Meijer et al., Translational repression and eIF4A2 activity are critical for microRNA-mediated gene regulation, Science, 340(6128):82-5 (2013).
Meister et al., Human Argonaute2 mediates RNA cleavage targeted by miRNAs and siRNAs, Mol. Cell, 15(2):185-97 (2004).
Miyazaki et al., Development of an anatomical technique for visualizing the mode of climbing fiber innervation in Purkinje cells and its application to mutant mice lacking GluR?2 and Ca(v)2.1, Anat. Sci. Int., 86(1):10-8 (2011).
Miyazaki et al., Viral delivery of miR-196a ameliorates the SBMA phenotype via the silencing of CELF2, Nat. Med., 18(7):1136-41 (2012).

Momen-Heravi et al., Exosomes derived from alcohol-treated hepatocytes horizontally transfer liver specific miRNA-122 and sensitize monocytes to LPS, Scientific Reports, 5:9991 (2015).
Moseley et al., Incidence of dominant spinocerebellar and Friedreich triplet repeats among 361 ataxia families, Neurology, 51(6):1666-71 (1998).
Najafi-Shoushtari et al., MicroRNA-33 and the SREBP host genes cooperate to control cholesterol homeostasis, Science, 328(5985):1566-9 (2010).
Nykanen et al., ATP requirements and small interfering RNA structure in the RNA interference pathway, Cell, 107(3):309-21 (2001).
Paulson, The spinocerebellar ataxias, J. Neuroophthalmol., 29(3):227-37 (2009).
Peng et al., Micro RNA delivery for regenerative medicine, Adv. Drug Deliv. Rev., 88:108-22 (2015).
Perlman, Spinocerebellar degenerations, Handb. Clin. Neurol., 100:113-40 (2011).
Pestova et al., Canonical eukaryotic initiation factors determine initiation of translation by internal ribosomal entry, Mol. Cell Biol., 16(12):6859-69 (1996).
Pestova et al., Functional dissection of eukaryotic initiation factor 4F: the 4A subunit and the central domain of the 4G subunit are sufficient to mediate internal entry of 43S preinitiation complexes, Mol. Cell Biol., 16(12):6870-8 (1996).
Peters et al., Argonaute proteins: mediators of RNA silencing, Mol. Cell, 26(5):611-23 (2007).
Piao et al., Lipid-based nanoparticle delivery of Pre-miR-107 inhibits the tumorigenicity of head and neck squamous cell carcinoma, Mol. Ther., 20(6):1261-9 (2012).
Piedras-Renteria et al., Increased Expression of a1A Ca2+Channel Currents Arising from Expanded Trinucleotide Repeats in Spinocerebellar Ataxia Type 6, J. Neurosci., 21(23):9185-93 (2001).
Qian et al., Pulmonary delivery of a GLP-1 receptor agonist, BMS-686117, Int. J. Pharm., 366(1-2):218-20 (2009).
Qian et al., Sustained release subcutaneous delivery of BMS-686117, a GLP-1 receptor peptide agonist, via a zinc adduct, Int. J. Pharm., 374(1-2):46-52 (2009).
Rai et al., Liposomal delivery of MicroRNA-7-expressing plasmid overcomes epidermal growth factor receptor tyrosine kinase inhibitor-resistance in lung cancer cells, Mol. Cancer Ther., 10(9):1720-7 (2011).
Rajakulendran et al., Neuronal P/Q-type calcium channel dysfunction in inherited disorders of the CNS, Nat. Rev. Neurol., 8(2):86-96 (2012).
Ren et al., Co-delivery of as-miR-21 and 5-FU by poly(amidoamine) dendrimer attenuates human glioma cell growth in vitro, J. Biomater. Sci. Polym. Ed., 21(3):303-14 (2010).
Ren et al., MicroRNA-21 inhibitor sensitizes human glioblastoma cells U251 (PTEN-mutant) and LN229 (PTEN-wild type) to taxol, BMC Cancer, 10:27 (2010).
Restituito et al., The polyglutamine expansion in spinocerebellar ataxia type 6 causes a beta subunit-specific enhanced activation of P/Q-type calcium channels in Xenopus oocytes, J. Neurosci., 20(17):6394-403 (2000).
Riley et al., Polyglutamine neurodegenerative diseases and regulation of transcription: assembling the puzzle, Genes Dev., 20:2183-92 (2006).
Robertson et al., Towards the treatment of polyglutamine diseases: the modulatory role of protein context, Curr. Med. Chem., 17(27):3058-68 (2010).
Roubertie et al., Benign paroxysmal tonic upgaze, benign paroxysmal torticollis, episodic ataxia and CACNA1A mutation in a family, J. Neurol., 255(10):1600-2 (2008).
Rüb et al., Clinical features, neurogenetics and neuropathology of the polyglutamine spinocerebellar ataxias type 1, 2, 3, 6 and 7, Prog. Neurobiol., 104:38-66 (2013).
Saegusa et al., Properties of human Cav2.1 channel with a spinocerebellar ataxia type 6 mutation expressed in Purkinje cells, Mol. Cell Neurosci., 34(2):261-70 (2007).
Sato et al., CENTROIDFOLD: a web server for RNA secondary structure prediction, Nucleic Acids Res., 37 (Web Server Issue):W277-80 (2009).

(56) References Cited

OTHER PUBLICATIONS

Scott et al., Evidence for a 95 kDa short form of the alpha1A subunit associated with the omega-conotoxin MVIIC receptor of the P/Q-type Ca2+ channels, J. Neurosci., 18(2):641-7 (1998).
Seidel et al., Brain pathology of spinocerebellar ataxias, Acta Neuropathol., 124(1):1-21 (2012).
Sharp, RNA interference—2001, Genes Dev., 15(5):485-90 (2001).
Shi et al., Systemic delivery of microRNA-34a for cancer stem cell therapy, Angew. Chem. Int. Ed. Engl., 52(14):3901-5 (2013).
Shin et al., Expanding the microRNA targeting code: functional sites with centered pairing, Mol. Cell, 38(6):789-802 (2010).
Southwell et al., Antisense oligonucleotide therapeutics for inherited neurodegenerative diseases, Trends Mol. Med., 18(11):634-43 (2012).
Spacey et al., Two novel CACNA1A gene mutations associated with episodic ataxia type 2 and interictal dystonia, Arch. Neurol., 62(2):314-6 (2005).
Stoneley et al., Analysis of the c-myc IRES; a potential role for cell-type specific trans-acting factors and the nuclear compartment, Nucleic Acids Res., 28(3):687-94 (2000).
Su et al., Silencing microRNA by interfering nanoparticles in mice, Nucleic Acids Res., 39(6):e38 (2011).
Takiyama et al., A Japanese family with spinocerebellar ataxia type 6 which includes three individuals homozygous for an expanded CAG repeat in the SCA6/CACNL1A4 gene, J. Neurol. Sci., 158(2):141-7 (1998).
Tivnan et al., Inhibition of neuroblastoma tumor growth by targeted delivery of microRNA-34a using anti-disialoganglioside GD2 coated nanoparticles, PLoS One, 7(5):e38129 (2012).
Toru et al., Spinocerebellar ataxia type 6 mutation alters P-type calcium channel function, J. Biol. Chem., 275(15):10893-8 (2000).
Trang et al., Systemic delivery of tumor suppressor microRNA mimics using a neutral lipid emulsion inhibits lung tumors in mice, Mol. Ther., 19(6):1116-22 (2011).
Tsai et al., A novel Bcr-Abl-mTOR-eIF4A axis regulates IRES-mediated translation of LEF-1, Open Biol., 4(11):140180 (2014).
Tsuji et al., Sporadic ataxias in Japan—a population-based epidemiological study, Cerebellum, 7(2):189-97 (2008).
Ui-Tei et al., Sensitive assay of RNA interference in *Drosophila* and Chinese hamster cultured cells using firefly luciferase gene as target, FEBS Lett., 479(3):79-82 (2000).
Usme-Ciro et al., Cytoplasmic RNA viruses as potential vehicles for the delivery of therapeutic small RNAs, Virol. J., 10:185 (2013).
Valdmanis et al., Expression determinants of mammalian argonaute proteins in mediating gene silencing, Nucleic Acids Res., 40(8):3704-13 (2012).
Van Rooij et al., Developing microRNA therapeutics, Circ. Res., 110(3):496-507 (2012).
Wang et al., Distinct passenger strand and mRNA cleavage activities of human Argonaute proteins, Nat. Struct. Mol. Biol., 16(12):1259-66 (2009).
Wang et al., Macrophage-secreted Exosomes Delivering miRNA-21 Inhibitor can Regulate BGC-823 Cell Proliferation, Asian Pac. J. Cancer Previ., 16(10):4203-9 (2015).
Wang et al., Recent progress in microRNA delivery for cancer therapy by non-viral synthetic vectors, Adv. Drug Deliv. Rev., 81:142-60 (2015).
Wardle et al., The genetic aetiology of late-onset chronic progressive cerebellar ataxia. A population-based study, J. Neurol., 256(3):343-8 (2009).
Watase et al., Spinocerebellar ataxia type 6 knockin mice develop a progressive neuronal dysfunction with age-dependent accumulation of mutant CaV2.1 channels, Proc. Natl. Acad. Sci. USA, 105(33):11987-92 (2008).
Webb et al., An internal ribosome entry site in the 5' untranslated region of epidermal growth factor receptor allows hypoxic expression, Oncogenesis, 4:e134 (2015).
Wei et al., siRNA has greatly elevated mismatch tolerance at 3'-UTR sites, PLoS One, 7(11):e49309 (2012).
Weingarten-Gabbay et al., Comparative genetics. Systematic discovery of cap-independent translation sequences in human and viral genomes, Science, 351(6270). pii:aad4939 (2016).
Weingarten-Gabbay et al., The translation initiation factor DAP5 promotes IRES-driven translation of p53 mRNA, Oncogene, 33(5):611-8 (2014).
Wu et al., Genetic testing in spinocerebellar ataxia in Taiwan: expansions of trinucleotide repeats in SCA8 and SCA17 are associated with typical Parkinson's disease, Clin. Genet., 65(3):209-14 (2004).
Wu et al., MicroRNA delivery by cationic lipoplexes for lung cancer therapy, Mol. Pharm., 8(4):1381-9 (2011).
Yigit et al., Context-dependent differences in miR-10b breast oncogenesis can be targeted for the prevention and arrest of lymph node metastasis, Oncogene, 32(12):1530-8 (2013).
Zamore et al., RNAi: double-stranded RNA directs the ATP-dependent cleavage of mRNA at 21 to 23 nucleotide intervals, Cell, 101(1):25-33 (2000).
Zhang et al., Cell-free 3D scaffold with two-stage delivery of miRNA-26a to regenerate critical-sized bone defects, Nat. Commun., 7:10376 (2016).
Zhang et al., Progress in microRNA delivery, J. Control. Release, 172(3):962-74 (2013).
Zhou et al., Fine tuning of electrostatics around the internucleotidic phosphate through incorporation of modified 2',4'-carbocyclic-LNAs and -ENAs leads to significant modulation of antisense properties, J. Org. Chem., 74(1):118-34 (2009).
Zhou, Ultrasound-mediated drug/gene delivery in solid tumor treatment, J. Healthc. Eng., 4(2):223-54 (2013).
Zhuchenko et al., Autosomal dominant cerebellar ataxia (SCA6) associated with small polyglutamine expansions in the alpha 1A-voltage-dependent calcium channel, Nat. Genet., 15(1):62-9 (1997).

FIG. 1A
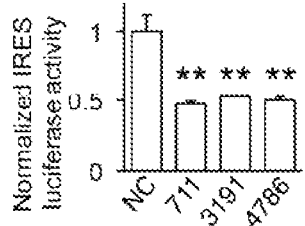
FIG. 1B
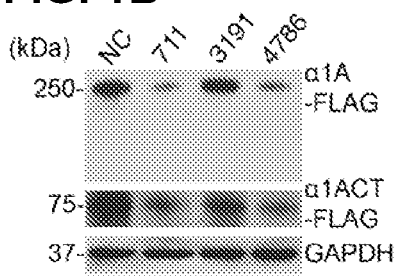
FIG. 1C
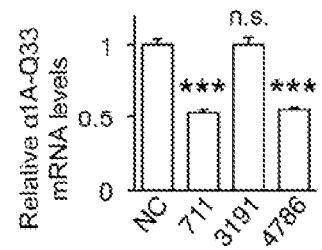
FIG. 1D
```
              miR-3191-5p    acCUUC - - CAUCUGCCGGUCUCuc   SEQ ID NO: 179
                             | | | | |    | |   | | | | | |
             CACNA1A IRES    ggGAAGAAGTGTC CGGCCA           SEQ ID NO: 180
          CACNA1A IRESmut    ccCAACAACT CTGGCCCCA           SEQ ID NO: 227
```
FIG. 1E
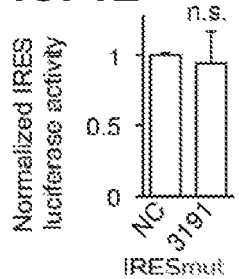
FIG. 1F
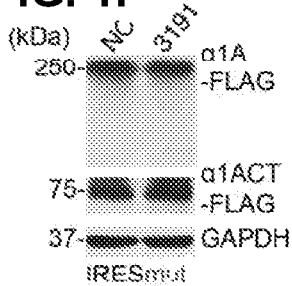
FIG. 1G
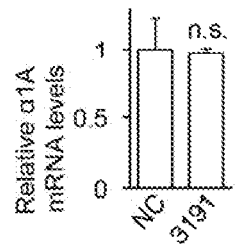
FIG. 1H
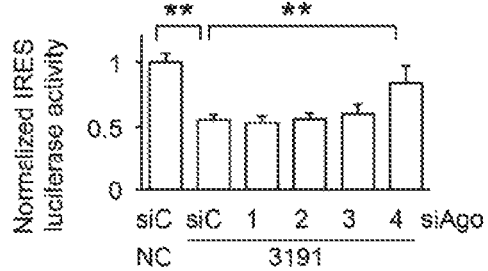
FIG. 1I
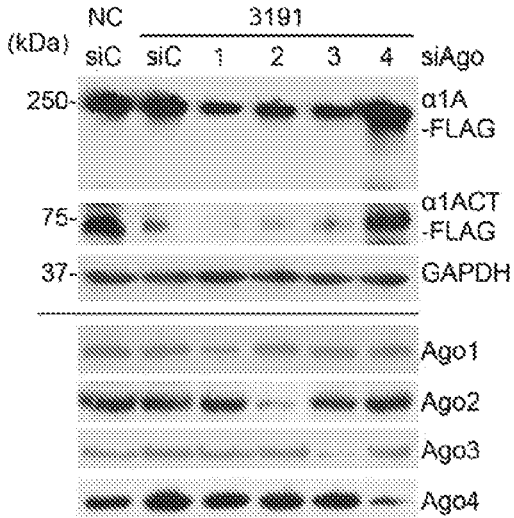
FIG. 1J
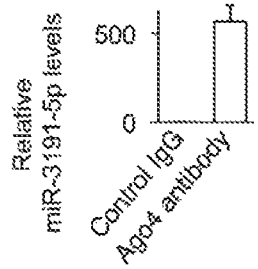
FIG. 1K
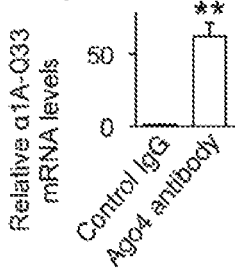

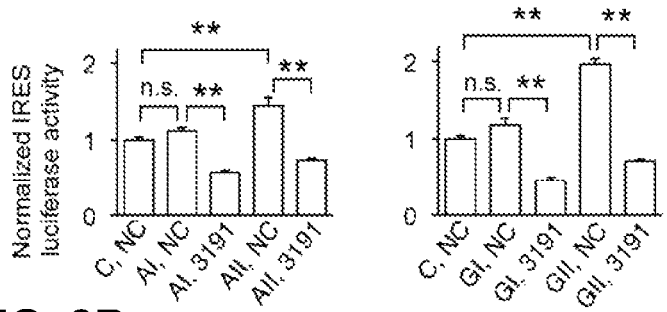
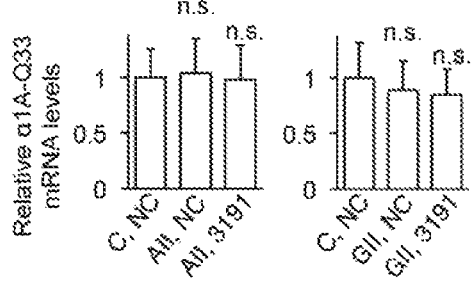
FIG. 2A
FIG. 2B
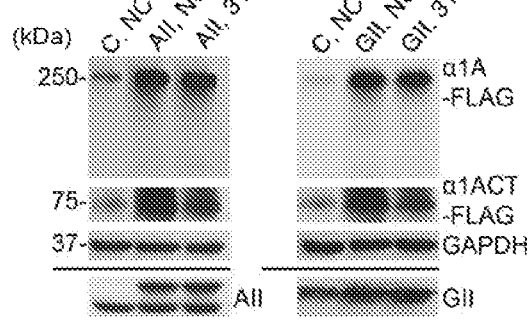
FIG. 2C
FIG. 2D
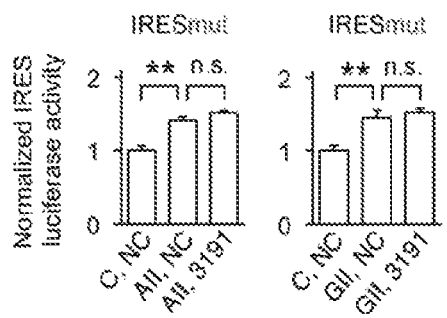
FIG. 2E
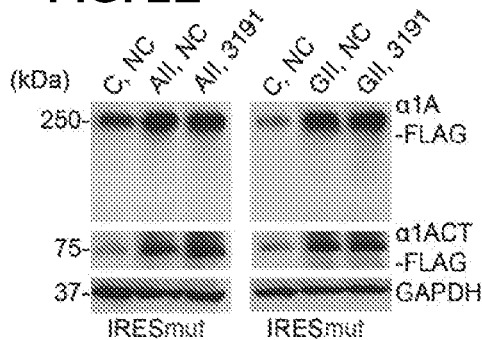
FIG. 2F FIG. 2G FIG. 2H
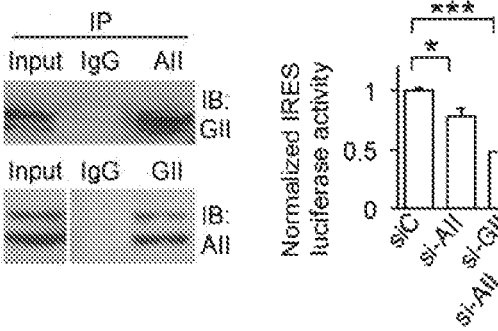
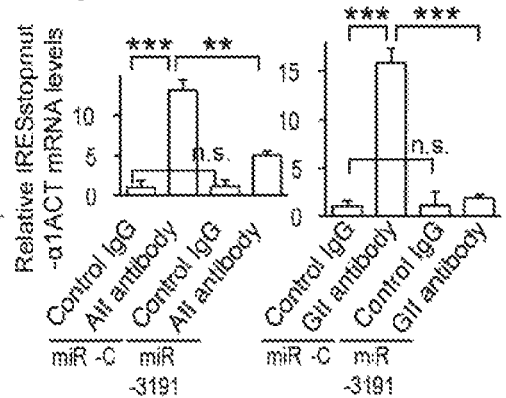

FIG. 5A
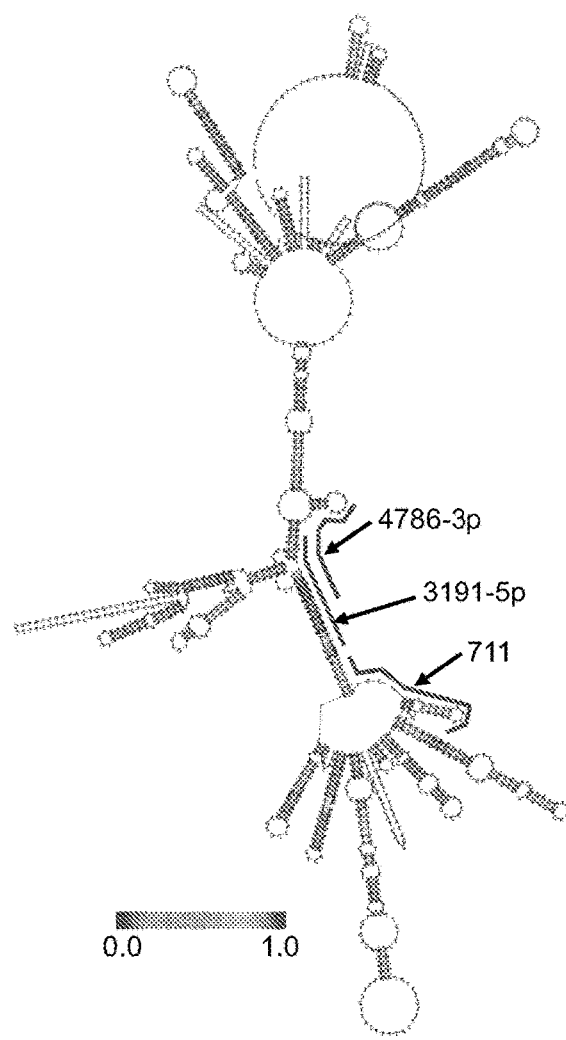
FIG. 5B
hsa-miR-711  SEQ ID NO: 225
3' gaaUGCAGAG- -AGGGACCCAGGg 5'
Target
5' cac AT GTCTCCGCCCCTGGGTCTg 3'
SEQ ID NO: 228
hsa-miR-3191-5p  SEQ ID NO: 179
3' ac CUUC— CAUCU GCCGGUCUCuc 5'
Target
5' gg GAAGAAGTGTC CGGCCA 3'
SEQ ID NO: 180
hsa-miR-4786-3p  SEQ ID NO: 226
3' cgGGUCUGGUCUCGACCGAAgu 5'
Target
5' tgTCCGGCCAGAG- -TGGCTTac 3'
SEQ ID NO: 229
FIG. 5C
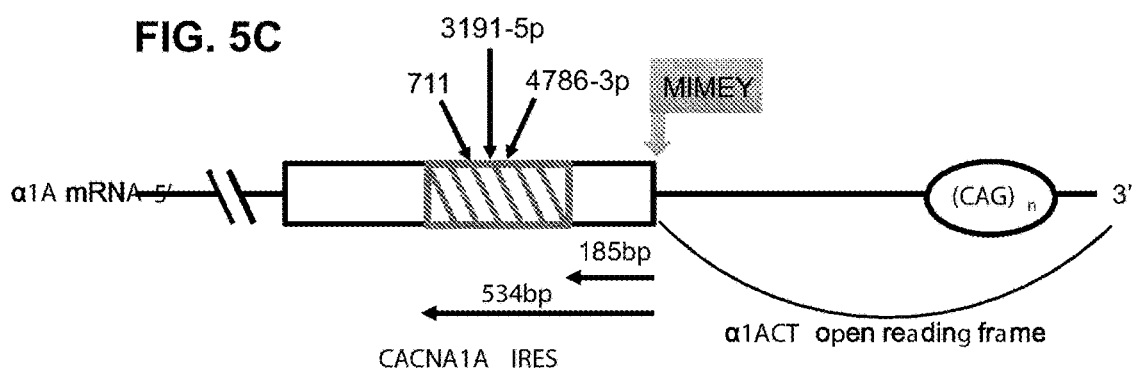

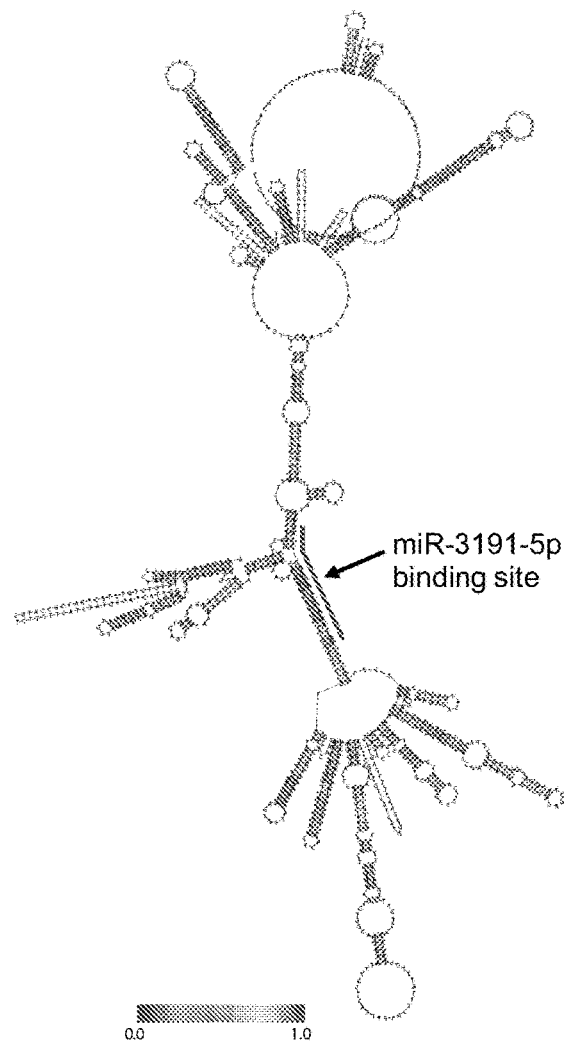
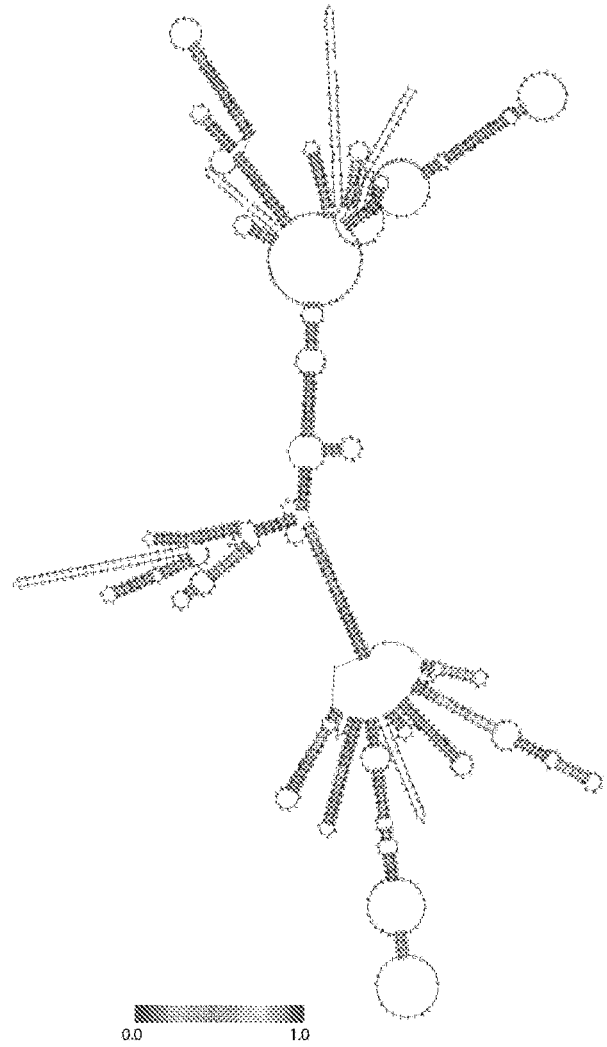
CACNA 1A IRES
CACNA 1A IRES mut
FIG. 8A
FIG. 8B

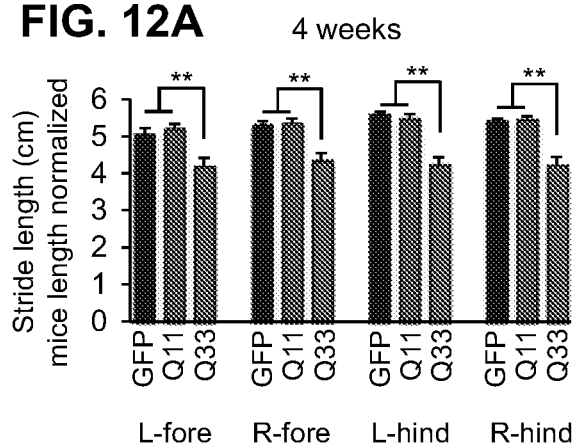
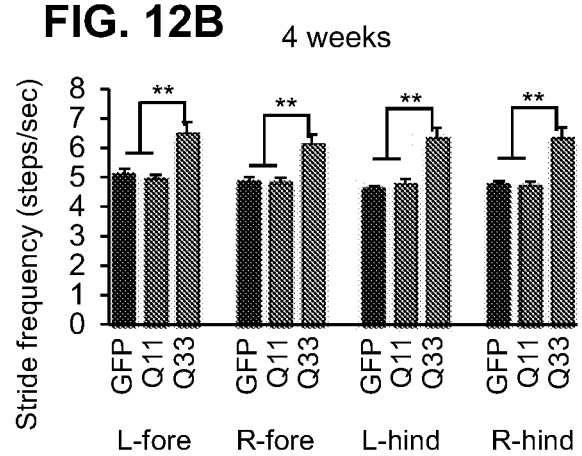
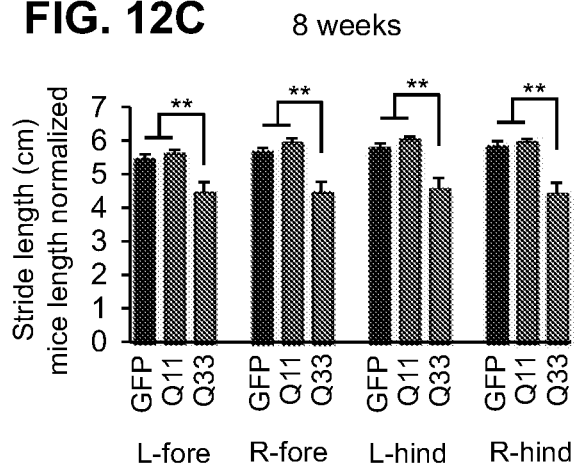
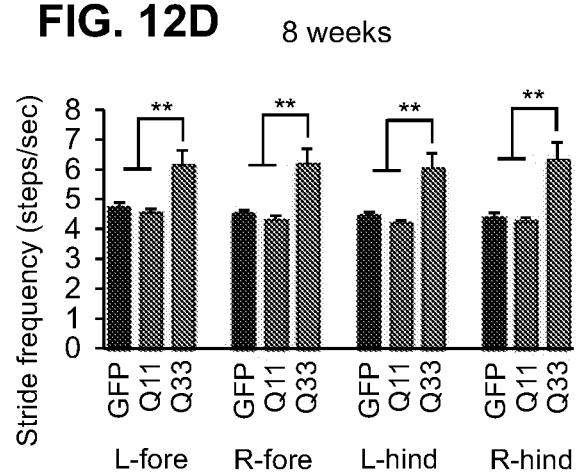
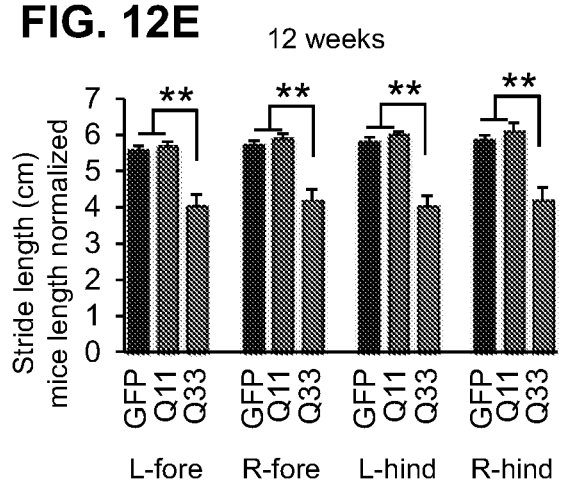
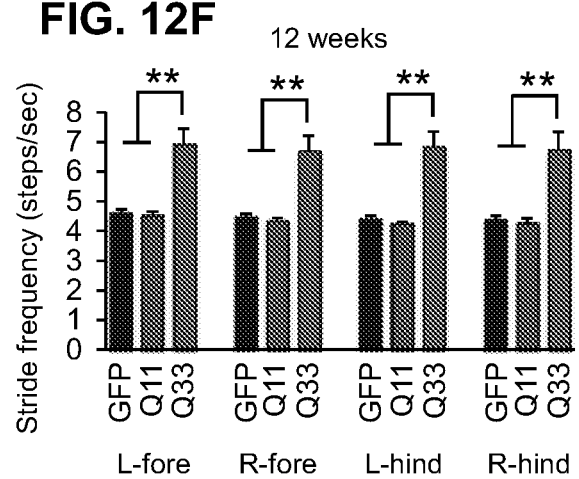

FIG. 16A
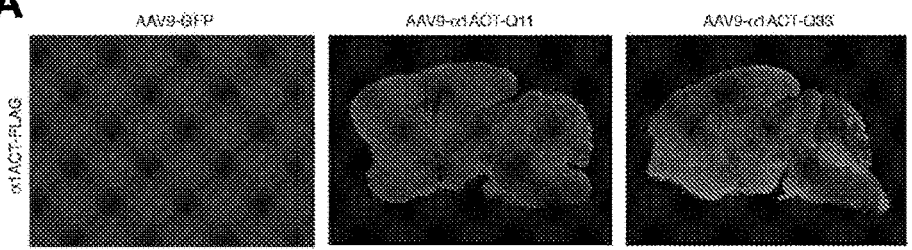
FIG. 16B     FIG. 16C     FIG. 16D
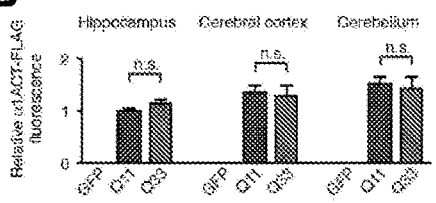 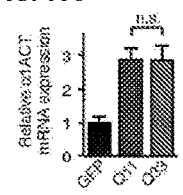 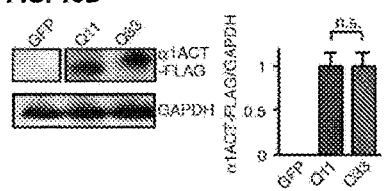
FIG. 16E
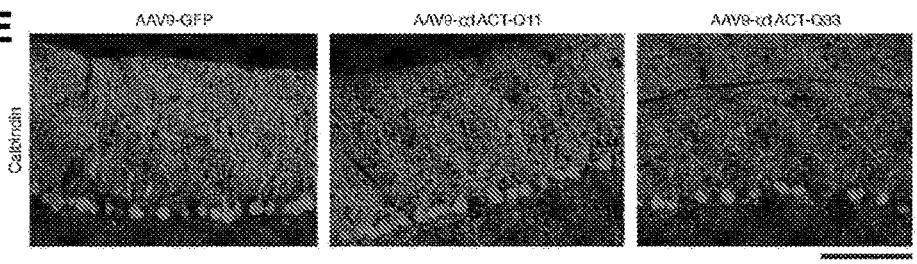
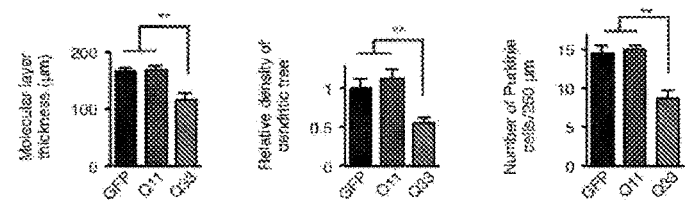
FIG. 16F     FIG. 16G     FIG. 16H

FIG. 17A  FIG. 17B  FIG. 17C
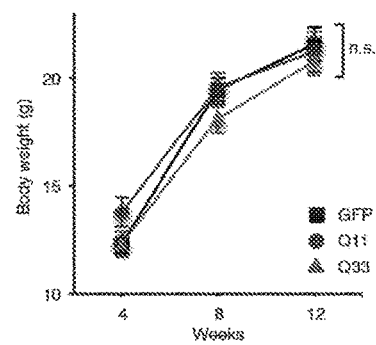 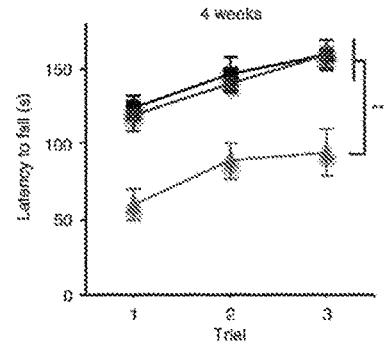 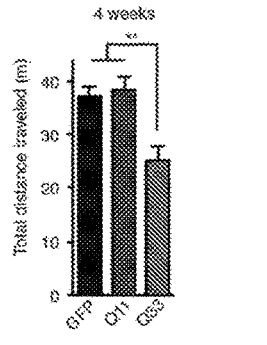
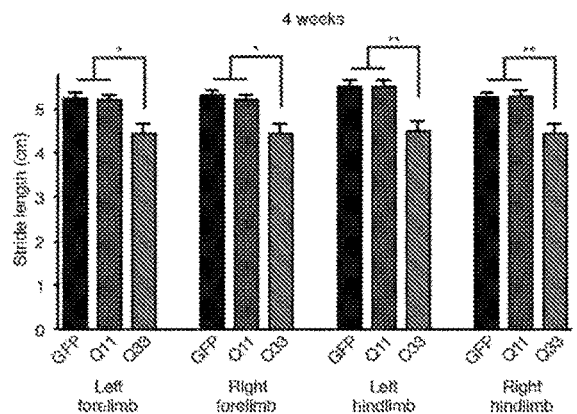 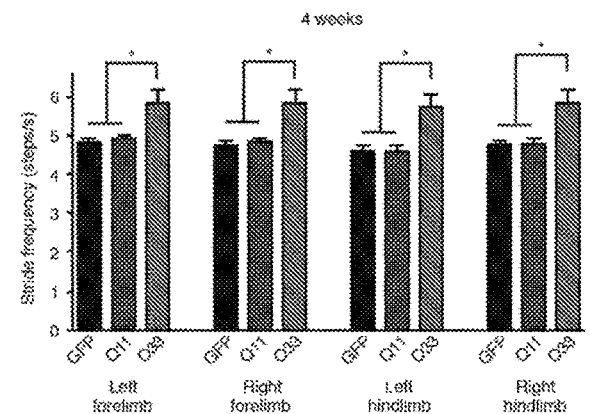
FIG. 17D  FIG. 17E

FIG. 18A
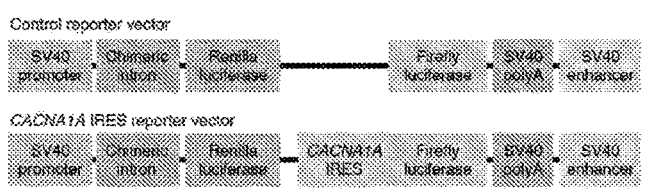
FIG. 18B
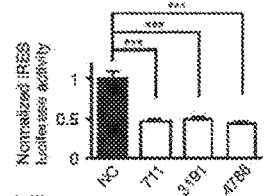
FIG. 18C FIG. 18D
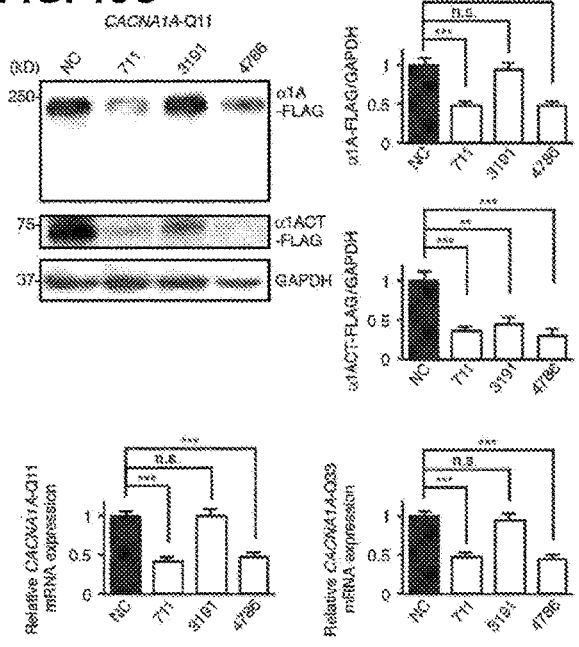 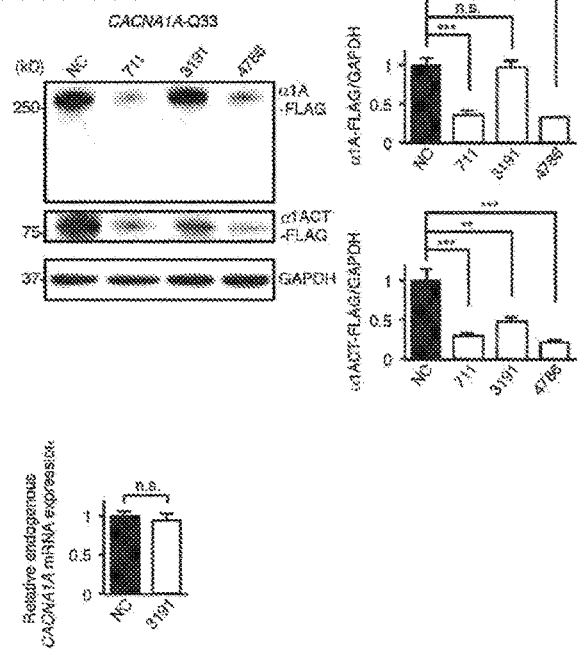
FIG. 18E  FIG. 18F  FIG. 18G

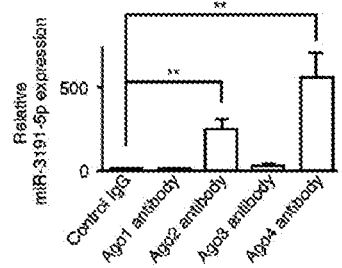 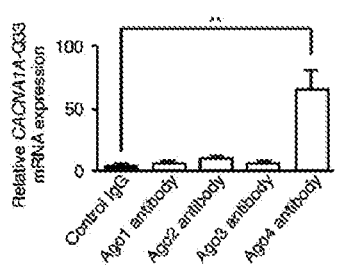 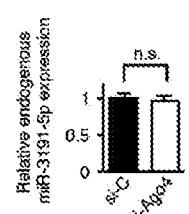
FIG. 19C  FIG. 19D  FIG. 19E

FIG. 20E 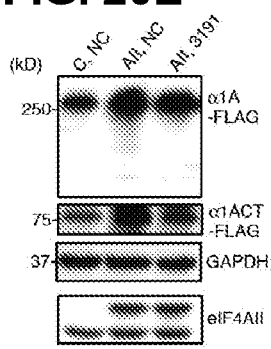 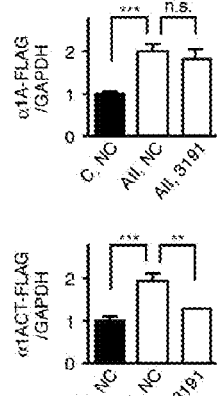
FIG. 20F 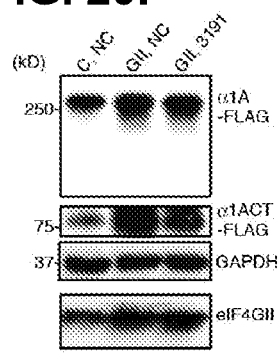 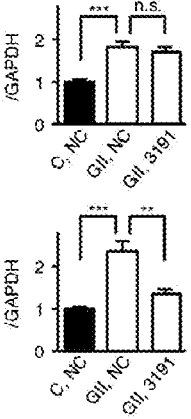

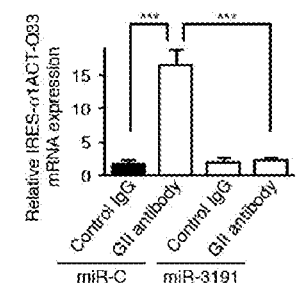
FIG. 20J
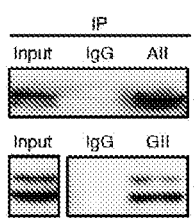
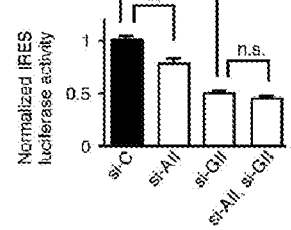
FIG. 20K  FIG. 20L

FIG. 21A
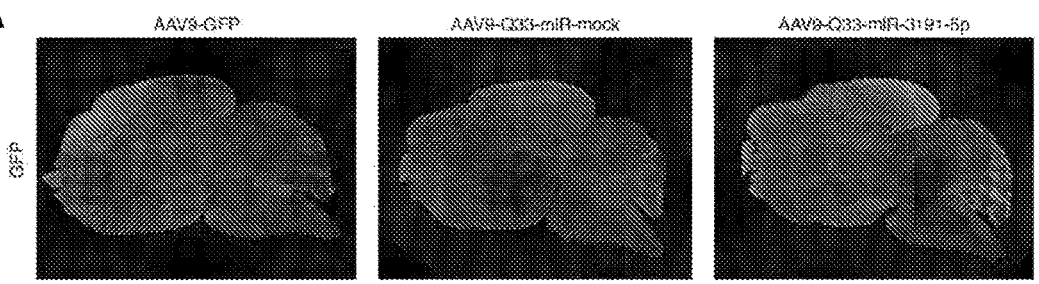
FIG. 21B
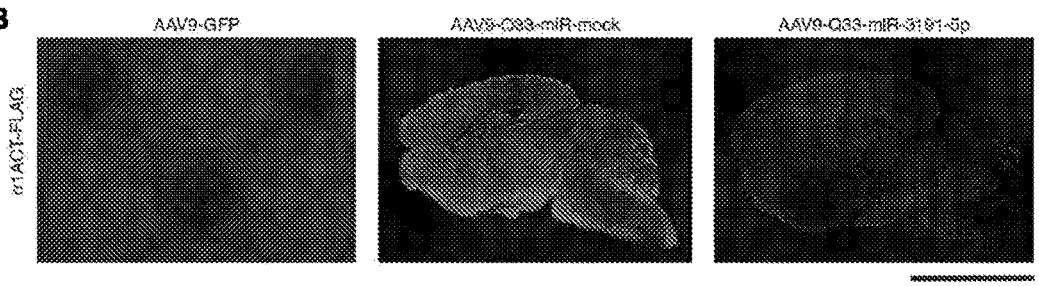
FIG. 21C FIG. 21D
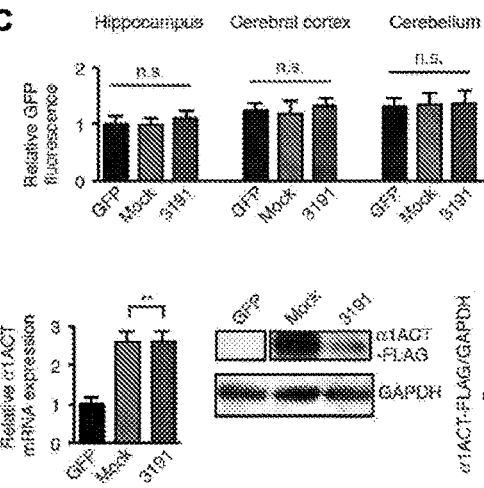 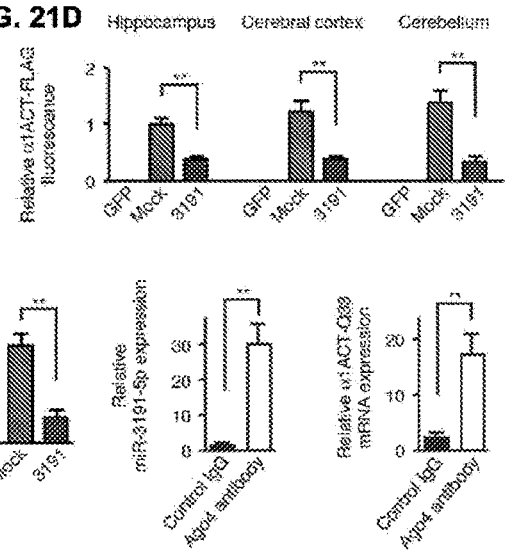
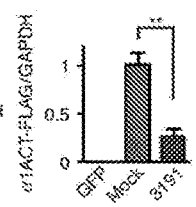 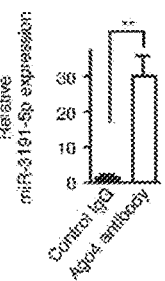
FIG. 21E FIG. 21F FIG. 21G FIG. 21H

FIG. 22A
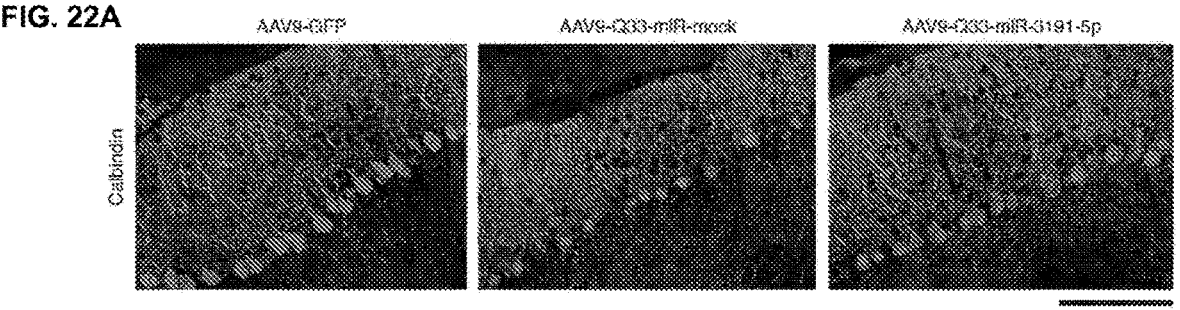
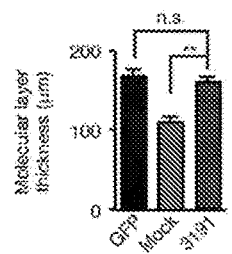
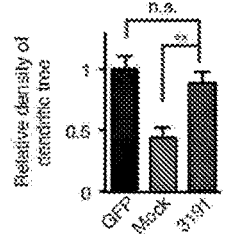
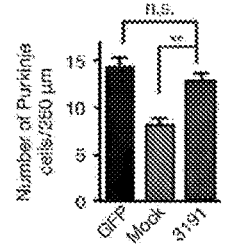
FIG. 22B　　　FIG. 22C　　　FIG. 22D

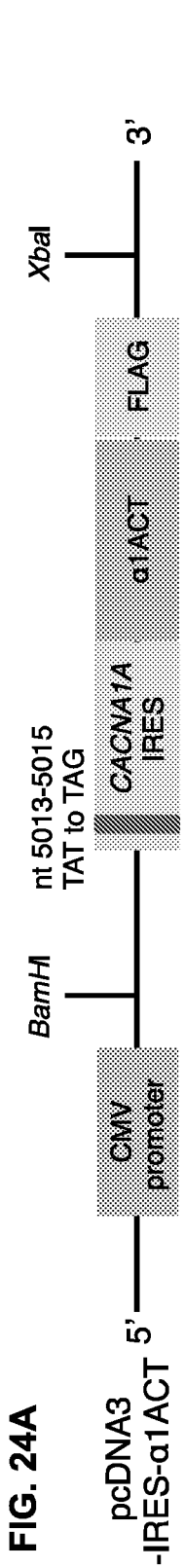
FIG. 24A
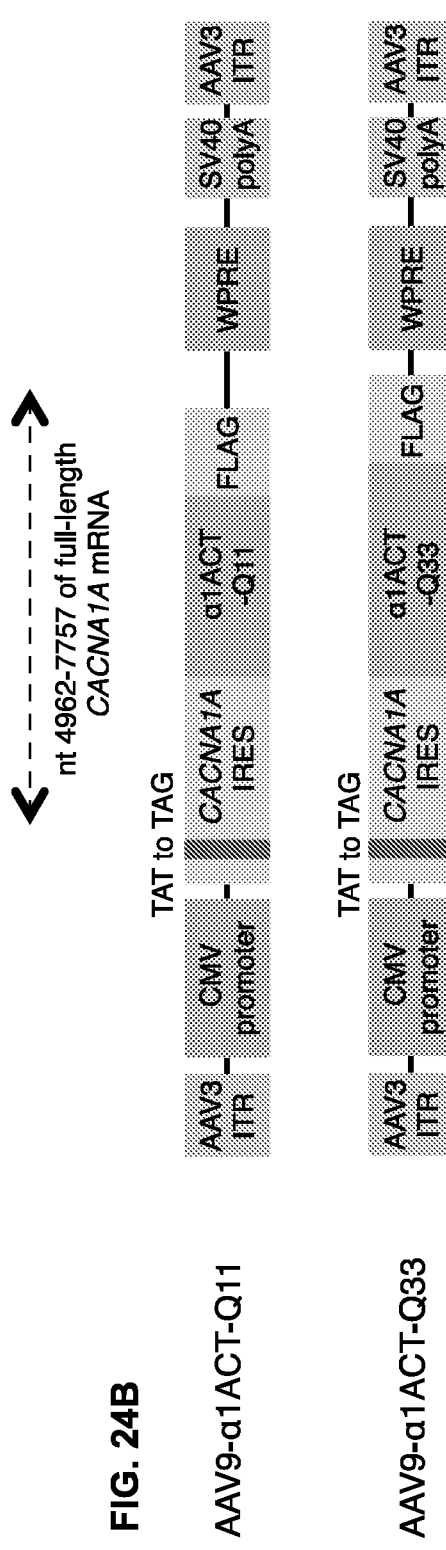
FIG. 24B
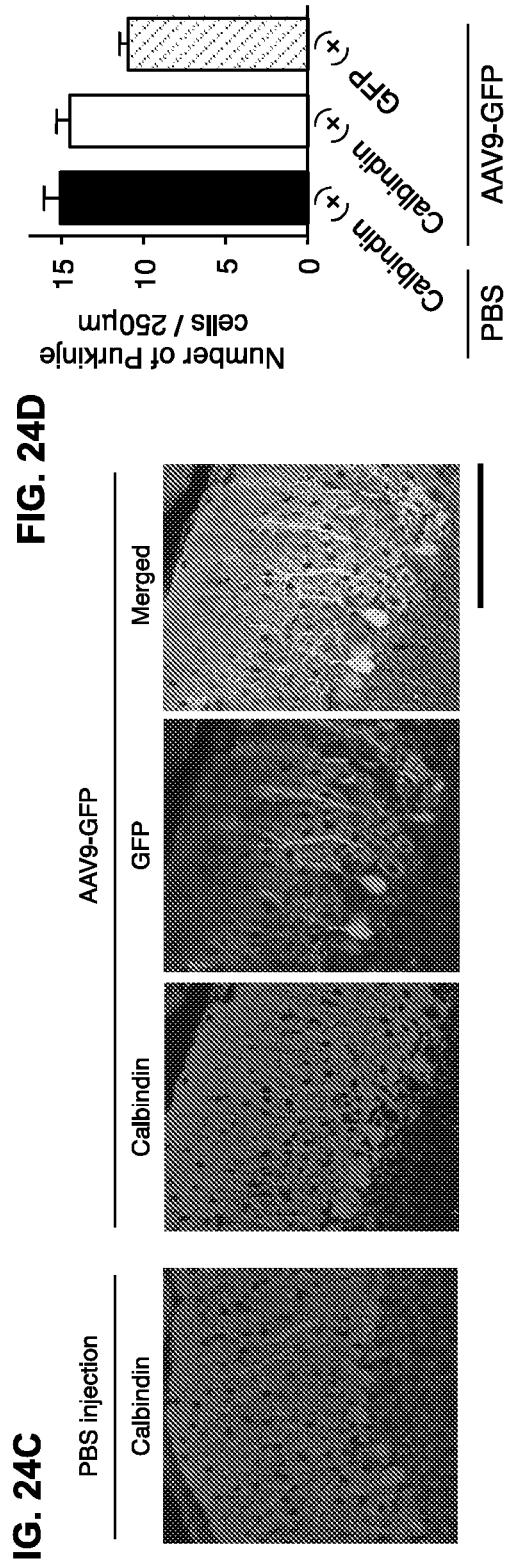
FIG. 24C
FIG. 24D

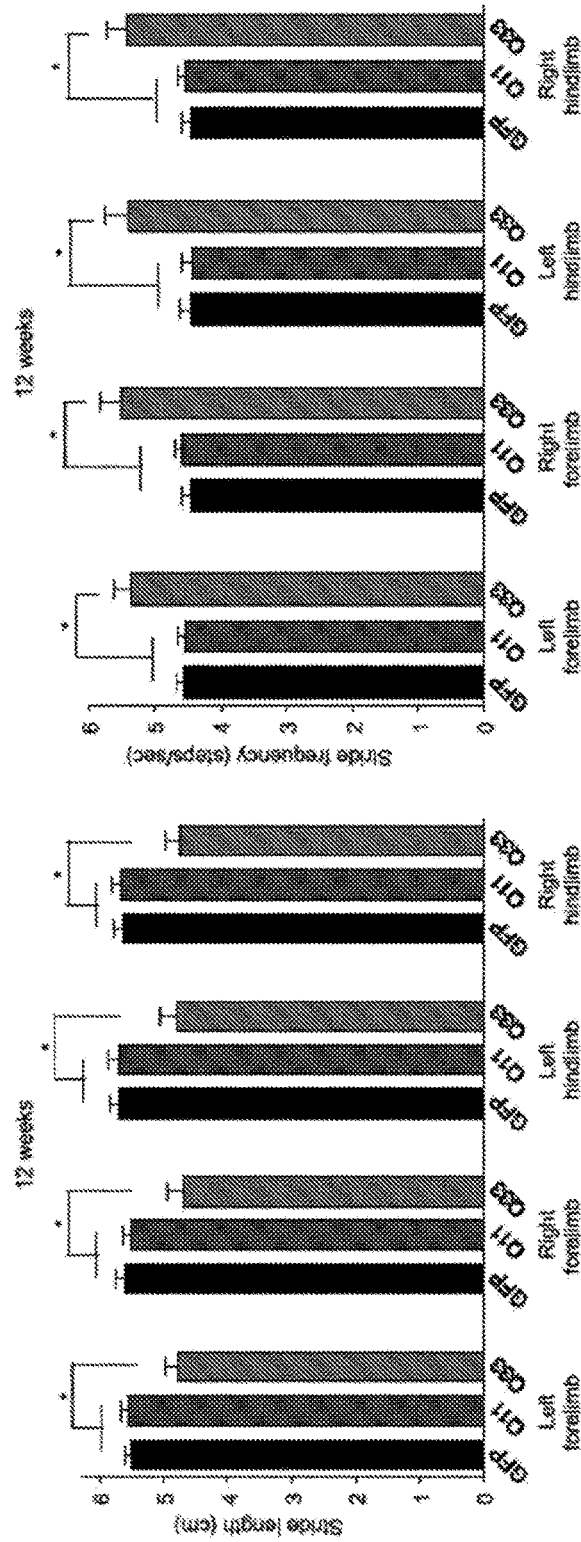
FIG. 26C
FIG. 26D
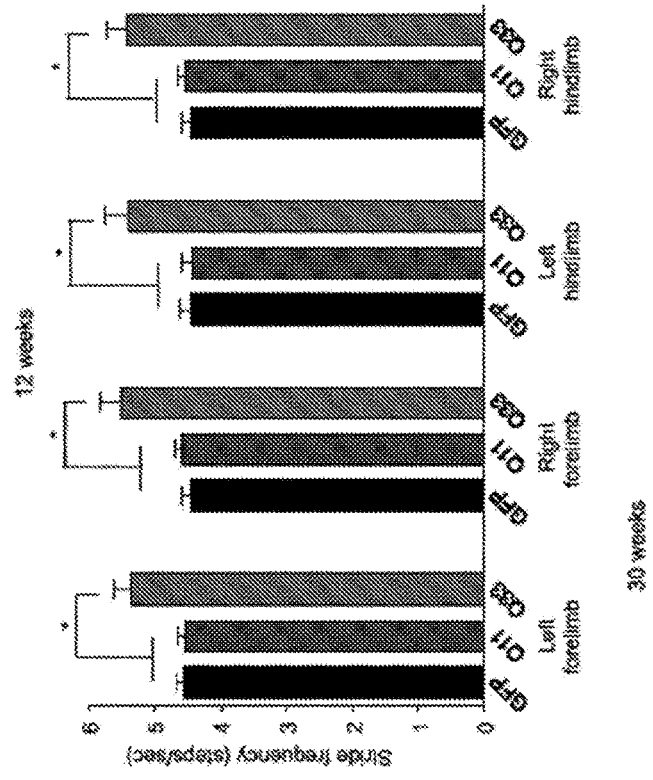
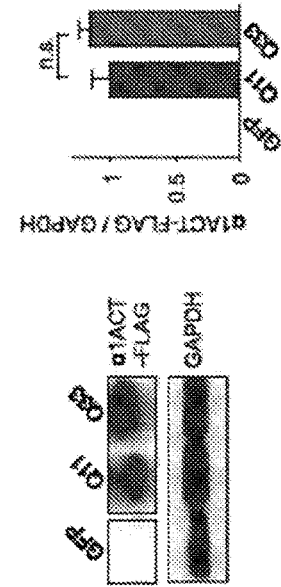
FIG. 26G
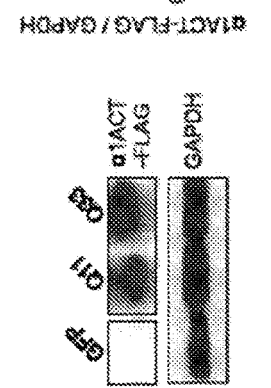
FIG. 26H
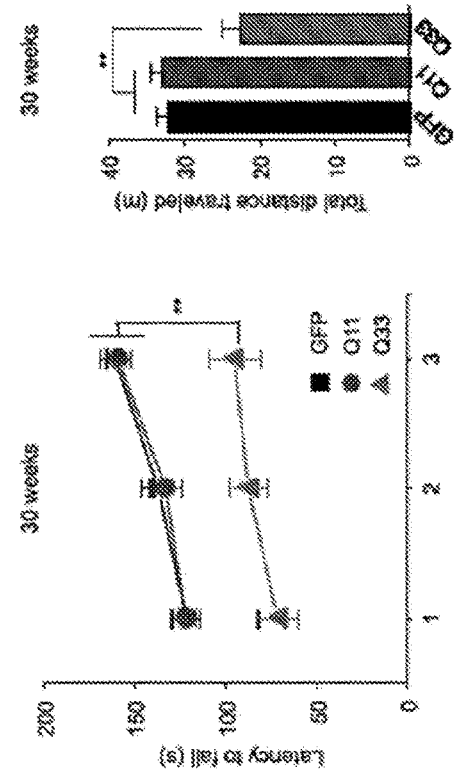
FIG. 26E
FIG. 26F SEQ ID NO: 225
<u>hsa-miR-711</u>
3' gaaUGCAGAG- -AGGGACCCAGGg 5'
     | | | | | | |   | | | | | | | |
     | | | | | | |   | | | | | | | |
     | | | | | | |   | | | | | | | |
<u>Target</u> | | | | | |   | | | | | | | |
5' cac AT GTCTCC GCCCCTGGGTCTg 3'
SEQ ID NO: 228

<u>hsa-miR-3191-5p</u>  SEQ ID NO: 179
3' ac CUUC— CAUCU GCCGGUCUCuc 5'
   | | | | |  | |    | | | | | |
   | | | | |  | |    | | | | | |
   | | | | |  | |    | | | | | |
<u>Target</u> | | | |  | |    | | | | | |
5' g g GAAGAAGTGTC CGGCCA 3'
SEQ ID NO: 180

<u>hsa-miR-4786-3p</u>  SEQ ID NO: 226
3' cgGGUCUGGUCUCGACCGAAgu 5'
  | | | | | | | |  | | | | | |
  | | | | | | | |  | | | | | |
  | | | | | | | |  | | | | | |
<u>Target</u> | | | | | | | |  | | | | | |
5' tgTCCGGCCAGAG- -TGGCTTac 3'
SEQ ID NO: 229

FIG. 28A  CACNA1A IRES
FIG. 28B  CACNA1A IRESmut
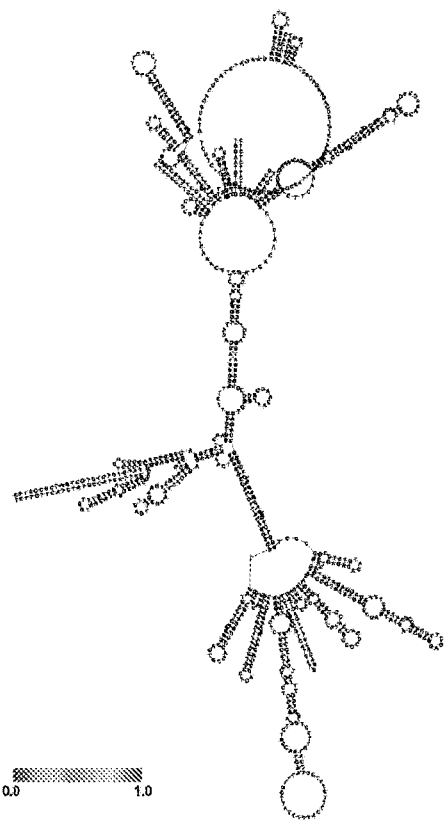
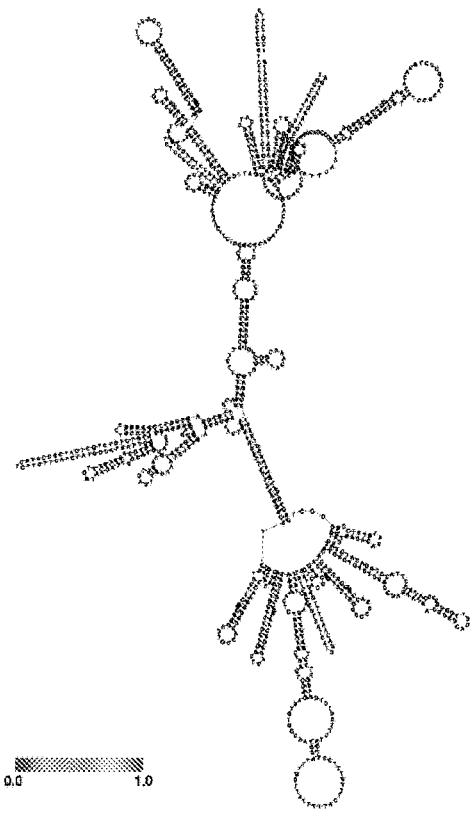
FIG. 28C
```
miR-3191-5p        acCUUC - -CAUCUGCCGGUCUCuc  SEQ ID NO: 179
                     |||||   ||    ||||||
CACNA1A IRES       ggGAAGAAGTGTCCGGCCA  SEQ ID NO: 180
CACNA1A IRESmut    cccAAcAAcTcTggccCCA  SEQ ID NO: 227
```
FIG. 28D
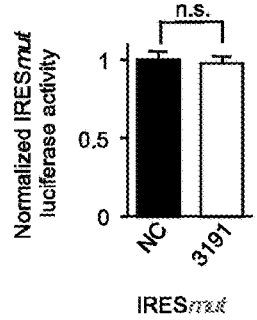
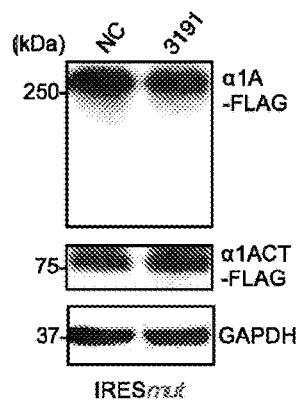
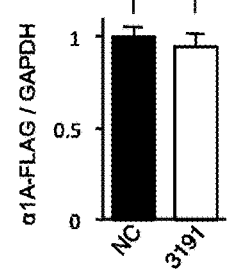
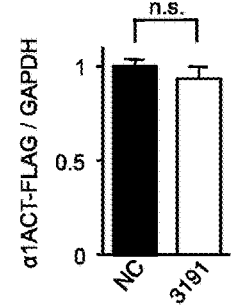
FIG. 28E

Initiation of IRES-driven α1ACT translation

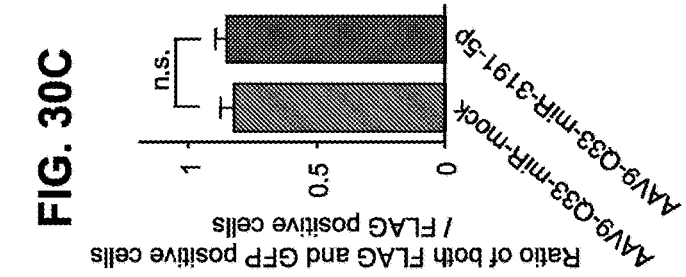
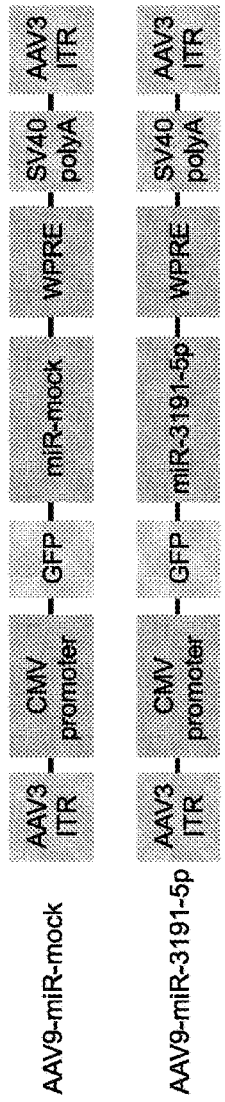
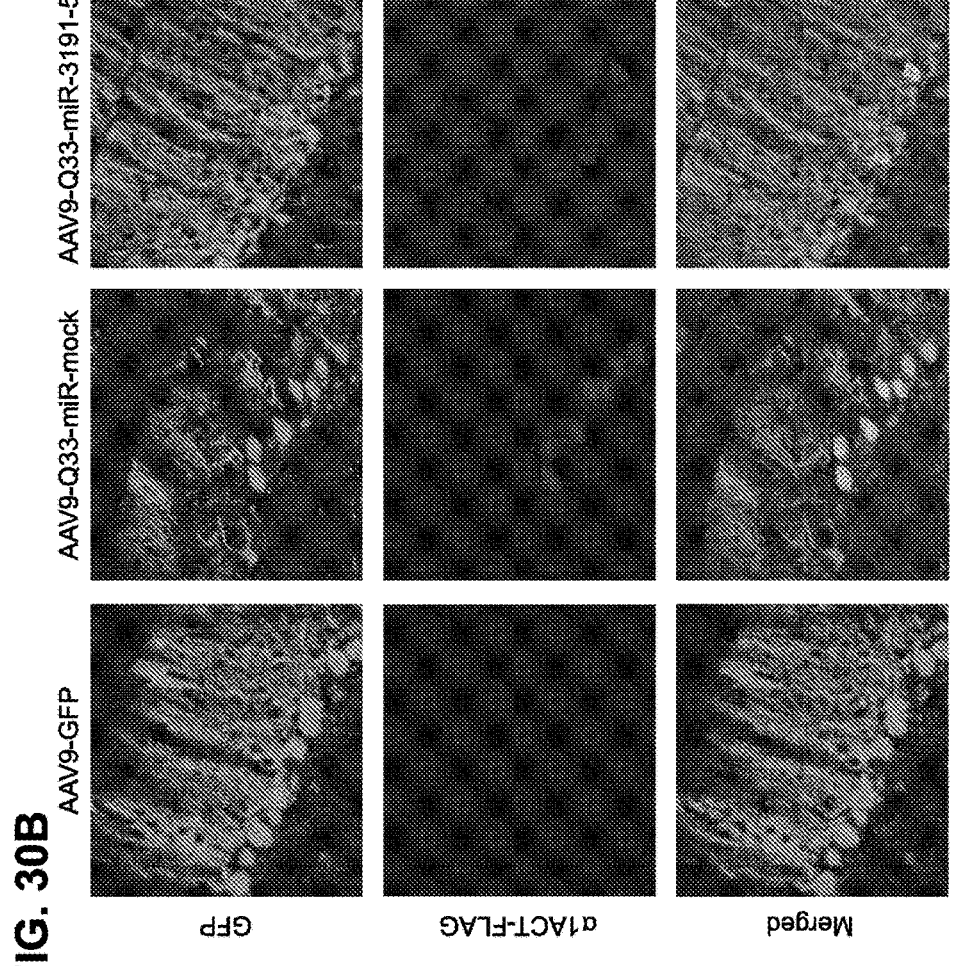

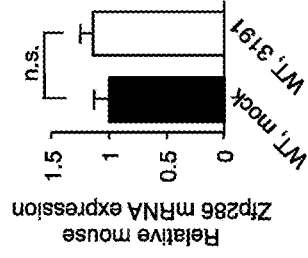
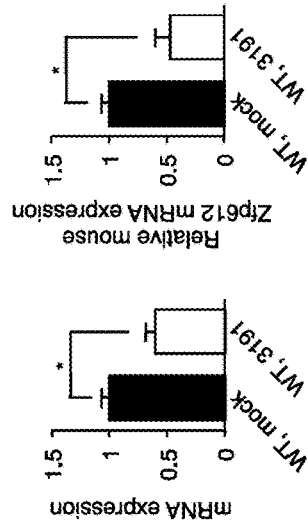
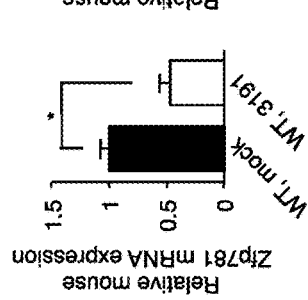
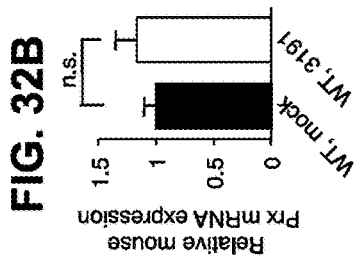
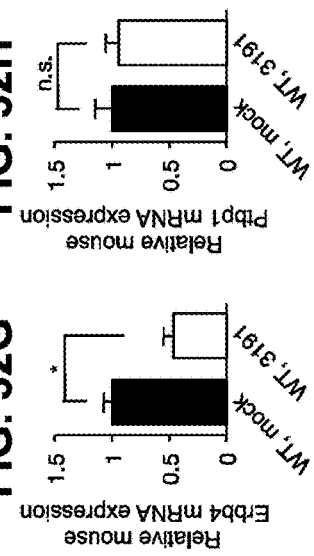
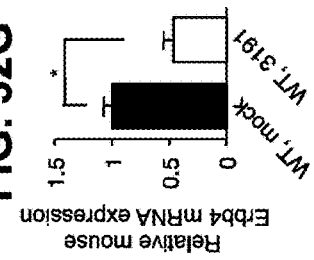

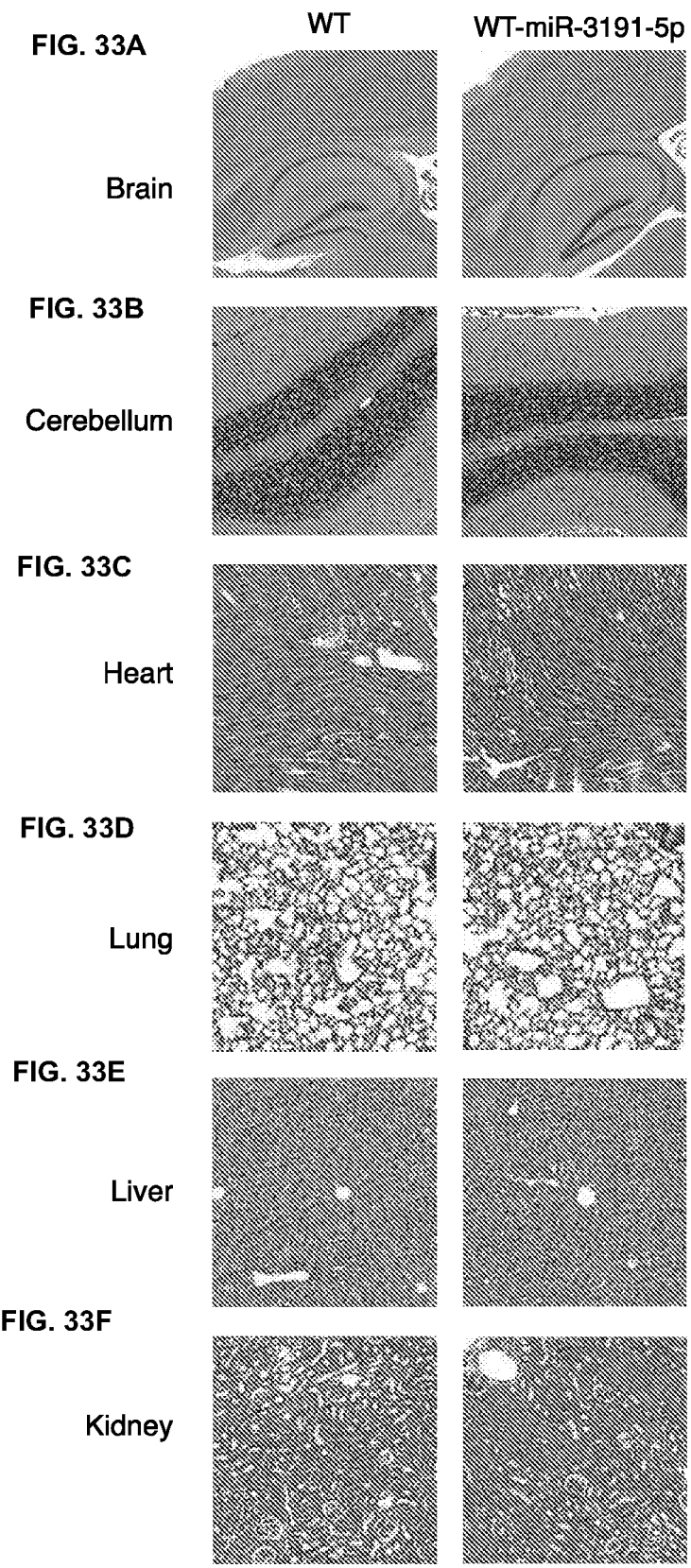
FIG. 33A Brain
FIG. 33B Cerebellum
FIG. 33C Heart
FIG. 33D Lung
FIG. 33E Liver
FIG. 33F Kidney

INHIBITORS OF CACNA1A/ALPHA1A SUBUNIT INTERNAL RIBOSOMAL ENTRY SITE (IRES) AND METHODS OF TREATING SPINOCEREBELLAR ATAXIA TYPE 6

CROSS-REFERENCE TO RELATED APPLICATIONS

This application is a divisional of U.S. application Ser. No. 15/743,560, filed on Jan. 10, 2018, which is a U.S. national stage application of International Application No. PCT/US16/45492, filed on Aug. 4, 2016, which claims priority to U.S. Provisional Patent Application No. 62/200,933, filed Aug. 4, 2015, the invention of which is incorporated herein by reference in their entirety.

GRANT FUNDING

This invention was made with government support under Grant No. R01NS082788 awarded by the National Institutes of Health. The government has certain rights in the invention.

INCORPORATION BY REFERENCE OF MATERIAL SUBMITTED ELECTRONICALLY

Incorporated by reference in its entirety is a computer-readable nucleotide/amino acid sequence listing submitted concurrently herewith and identified as follows: 843,341 byte ACII (Text) file named "27373/49857A_seqlisting.txt," created on Aug. 2, 2016.

BACKGROUND

Spinocerebellar ataxia type 6 (SCA6), a form of spinocerebellar ataxia (SCA), is a dominantly-inherited neurodegenerative disease characterized by progressive ataxia and Purkinje cell degeneration, associated with CAG repeat expansions in the gene, CACNA1A. SCA6 is a severe neurological disorder, and one of the most common SCAs worldwide (Moseley et al., Neurology. 1998; 51(6):1666-171; Wu et al., Clin Genet. 2004; 65(3):209-14; Jayadev et al., J Neurol Sci. 2006; 250(1-2):110-3; Basri et al., J Hum Genet. 2007; 52(10):848-55; Klockgether. Cerebellum. 2008; 7(2):101-5; Wardle et al., J Neurol. 2009; 256(3):343-348), roughly as prevalent as amyotrophic lateral sclerosis (Kurtzke J F. Adv Neurol. 1982; 36:281-302; Zhuchenko et al., Nature Genetics. 1997; 15(1):62-9; Craig K, et al., Ann Neurol. 2004; 55(5):752-5).

Initially, patients with SCA6 experience problems with coordination and balance (ataxia). Other early signs and symptoms of SCA6 include speech difficulties, involuntary eye movements (nystagmus), and double vision. Over time, individuals with SCA6 may develop loss of coordination in their arms, tremors, and uncontrolled muscle tensing (dystonia). Signs and symptoms of SCA6 typically begin in a person's forties or fifties but can appear anytime from childhood to late adulthood. Most people with this disorder require wheelchair assistance by the time they are in their sixties. Patients with genetically distinct forms of SCA, including SCA6, become disabled and may progress to severe incapacitation. Many patients die prematurely due to aspiration pneumonia or respiratory failure (Perlman S L. Handb Clin Neurol. 2011; 100:113-40; Klockgether T., Curr Opin Neurol. 2011; 24(4):339-45; Marelli C, et al., Rev Neurol (Paris). 2011; 167(5):385-400). The advent of modern molecular genetics has enabled the confirmed molecular diagnosis and characterization of many distinct forms of SCA (Durr A. Lancet Neurol. 2010; 9(9):885-94). The most reliable prevalence estimates of these heterogeneous disorders are on the order of 18-50/100,000 (Craig et al., (2004), supra, Tsuji S, et al., Cerebellum. 2008; 7(2):189-97). Thus, these disorders create a substantial economic and societal burden (Lopez-Bastida et al., Mov Disord. 2008; 23(2):212-7).

Current treatment of patients with SCA6 is focused on the treatment of manifestations. For example, acetazolamide is given to patients to eliminate episodes of ataxia, while vestibular suppressants are given to reduce vertigo and/or osscilopsia. Ophthalmology consultation is provided for refractive or surgical management of diplopia. Clonazepam is given for REM sleep disorders. Home modifications are suggested for safety and convenience. Canes, walking sticks, and walkers are prescribed in order to prevent falling. Physical therapy may also be prescribed to maximize compensation and strength, while speech therapy and communication devices are given for dysarthria. Weighted eating utensils and dressing hooks are suggested, while video esophagrams are provided to identify safest behaviors and consistency of food least likely to trigger aspiration. Feeding assessment when dysphagia becomes troublesome is considered. Furthermore, weight control, as obesity exacerbates ambulation and mobility difficulties, is provided. Moreover, CPAP may be administered to patients for sleep apnea.

However, no preventive treatment exists for the numerous polyglutamine (polyQ) diseases, including SCA6, and, currently, there are no treatments that target SCA6 itself. Thus, a method of treating SCA6, rather than a method of treating SCA6 manifestations, is needed.

SUMMARY

Presented herein are data relating to the origin and function of the α1ACT polypeptide in physiology and disease. Previously, it has been demonstrated that α1ACT is generated from the full-length α1A transcript by means of a cellular internal ribosomal entry site (IRES) located within the α1A mRNA, i.e., that the CACNA1A gene is bi-cistronic (Du et al., Cell 154:118-133 (2013). The α1ACT protein containing the normal polyQ tract is a transcription factor that binds and enhances expression of several Purkinje cell (PC)-expressed genes, promotes neurite outgrowth, and partially rescues the CACNA1A knockout phenotype. α1ACT with an expanded polyQ has altered function, reduces viability of cells in vitro, and causes gait impairment and cerebellar cortical atrophy in vivo. A truly bi-cistronic, dual-function, cellular gene encoding two proteins with completely distinct functions, in this case an ion channel and a transcription factor, was reported (Du et al. (2013), supra). This gene expression strategy demonstrates a novel role for an IRES in coordinating gene expression, as well as a potential therapeutic target for disease modifying therapy.

Provided herein are data demonstrating the selective inhibition of the expression of α1ACT encoded by the CACNA1A gene, without inhibiting the expression of α1A encoded by the same gene, upon administration of an IRES inhibitor described herein. Also provided herein are data demonstrating the inhibition of the translational initiation of CACNA1A gene-driven α1ACT by eIF4AII and EIF4GII. Further provided herein are data demonstrating the inhibition or prevention of Purkinje cell degeneration caused by CACNA1A gene-driven α1ACT$_{SCA6}$. Furthermore, provided herein are data demonstrating the the inhibition or prevention of ataxia and motor deficits caused by CACNA1A gene-driven α1ACT$_{SCA6}$. Without being bound to a particular theory, these data support that administration of an IRES inhibitor described herein achieves treatment of SCA6 and other related diseases described herein.

Accordingly, the invention provides a method of treating a genetic disease in a subject. The method comprises the step of administering to the subject an IRES inhibitor in an amount effective for treating the genetic disease. In exemplary embodiments, the genetic disease is a trinucleotide repeat disorder. In exemplary embodiments, the trinucleotide repeat disorder is a polyglutamine disease. In exemplary aspects, the polyglutamine disease is spinocerebellar ataxia Type 6 (SCA6). In exemplary aspects, the IRES inhibitor of the invention are antisense molecules, as described herein. In exemplary aspects, the IRES inhibitor is a small, non-coding RNA, or an antisense nucleic acid analog thereof. In exemplary aspects, the antisense molecule is a microRNA (miRNA) or small interfering RNA (siRNA). In exemplary aspects, the antisense molecule binds to the IRES of the CACNA1A gene and, optionally, to Argonaute 4 (Ago4). In exemplary aspects, the antisense molecule binds to a portion of the IRES comprising the sequence of SEQ ID NO: 180. In exemplary aspects, the antisense molecule binds to a portion of the sequence of SEQ ID NO: 180. In exemplary aspects, the antisense molecule inhibits the expression of α1ACT encoded by the CACNA1A gene. In exemplary aspects, the antisense molecule does not inhibit expression of α1A encoded by the CACNA1A gene. In exemplary aspects, the antisense molecule selectively inhibits the expression of α1ACT encoded by the CACNA1A gene, but does not inhibit expression of α1A encoded by the CACNA1A gene. In exemplary embodiments, the IRES inhibitor is (i) an antisense molecule that binds to a portion of an IRES of a CACNA1A gene comprising the sequence of SEQ ID NO: 180, optionally, wherein the antisense molecule binds to Argonaute 4 (Ago4), (ii) a vector encoding the antisense molecule, (iii) a cell comprising the vector or antisense molecule, (iv) a extracellular vesicle comprising the antisense molecule, or (v) a combination thereof. Optionally, the vector is a recombinant expression vector of as described herein, the cell is a cell as described herein, or the extracellular vesicle is an extracellular vesicle as described herein.

Accordingly, the invention provides a method of treating spinocerebellar ataxia Type 6 (SCA6). In exemplary embodiments, the method comprises the step of administering to the subject an IRES inhibitor in an amount effective for treating the SCA6 in the subject. In exemplary embodiments, the method comprises administering to the subject (i) an antisense molecule that binds to a portion of an IRES of a CACNA1A gene comprising the sequence of SEQ ID NO: 180, optionally, wherein the antisense molecule binds to Argonaute 4 (Ago4), (ii) a vector encoding the antisense molecule, (iii) a cell comprising the vector or antisense molecule, (iv) a extracellular vesicle comprising the antisense molecule, or (v) a combination thereof. Optionally, the vector is a recombinant expression vector of as described herein, the cell is a cell as described herein, or the extracellular vesicle is an extracellular vesicle as described herein.

The invention also provides a method of treating a subject with a predisposition to spinocerebellar ataxia Type 6 (SCA6). In exemplary embodiments, the method comprises the step of administering to the subject an IRES inhibitor in amount effective for delaying development of SCA6 in the subject. In exemplary embodiments, the method comprises administering to the subject (i) an antisense molecule that binds to a portion of an IRES of a CACNA1A gene comprising the sequence of SEQ ID NO: 180, optionally, wherein the antisense molecule binds to Argonaute 4 (Ago4), (ii) a vector encoding the antisense molecule, (iii) a cell comprising the vector or antisense molecule, (iv) a extracellular vesicle comprising the antisense molecule, or (v) a combination thereof. Optionally, the vector is a recombinant expression vector of as described herein, the cell is a cell as described herein, or the extracellular vesicle is an extracellular vesicle as described herein.

IRES inhibitors, including (i) antisense molecules that bind to a portion of an IRES of a CACNA1A gene comprising the sequence of SEQ ID NO: 180, optionally, wherein the antisense molecule binds to Argonaute 4 (Ago4), (ii) a vector encoding the antisense molecule, (iii) a cell comprising the vector or antisense molecule, (iv) a extracellular vesicle comprising the antisense molecule, or (v) a combination thereof, are provided herein. Pharmaceutical compositions comprising an IRES inhibitor, including (i) antisense molecules that bind to a portion of an IRES of a CACNA1A gene comprising the sequence of SEQ ID NO: 180, optionally, wherein the antisense molecule binds to Argonaute 4 (Ago4), (ii) a vector encoding the antisense molecule, (iii) a cell comprising the vector or antisense molecule, (iv) a extracellular vesicle comprising the antisense molecule, or (v) a combination thereof, are provided herein.

BRIEF DESCRIPTION OF THE DRAWINGS

FIGS. 1A-1K evidence that miR-3191-5p, in collaboration with Ago4, inhibits the IRES-driven translation of α1ACT$_{SCA6}$ while sparing α1A$_{SCA6}$ expression and α1A$_{SCA6}$ mRNA levels in HEK293 cells. (FIG. 1A) miR-711, −3191-5p, and −4786-3p significantly decreased CACNA1A IRES-driven luciferase activities. (FIG. 1B) miR-3191-5p down-regulated α1ACT-FLAG expression but spared α1A-FLAG expression, although miR-711 and −4786-3p did both. (FIG. 1C) miR-3191-5p produced no significant change in α1A-Q33 mRNA levels. (FIG. 1D) Nucleotide sequence of the miR-3191-5p binding region of the CACNA1A IRES and mutated CACNA1A IRES (IRESmut) templates bearing C>G and G>C substitutions within the predicted miR-3191-5p binding site. (FIG. 1E) Dual luciferase IRESmut reporter activities were not inhibited by miR-3191-5p. (FIG. 1F) CACNA1A-FLAG vector with IRESmut still expressed α1ACT, which was not inhibited by miR-3191-5p. (FIG. 1G) miR-3191-5p did not affect the expression levels of endogenous α1A mRNA in HEK293 cells. (FIG. 1H, FIG. 1I) The knockdown of Ago4 reversed the down-regulating effects of miR-3191-5p on the CACNA1A IRES-driven luciferase activities (FIG. 1H) and translation of α1ACT (FIG. 1I). (FIG. 1J, FIG. 1K) The levels of miR-3191-5p (FIG. 1J) and α1A-Q33 mRNA (FIG. 1K) precipitated by Ago4-specific antibodies were greater than control IgG. Data are means±S.E.M. P<0.01, *P<0.001. n.s.: not significant; siC: siRNA control; NC: miRNA negative control.

FIGS. 2A-2H demonstrate that the complex of eIF4AII and eIF4GII directly act on CACNA1A IRES to enhance IRES-driven translation of α1ACT that is inhibited by miR-3191-5p bound to Ago4 in HEK293 cells. (FIG. 2A) eIF4AII and eIF4GII increased CACNA1A IRES-driven luciferase activities that were reversed by the treatment with miR-3191-5p. (FIG. 2B) miR-3191-5p reversed the up-regulating effects of eIF4AII and eIF4GII on α1ACT-FLAG expression. (FIG. 2C) eIF4AII and eIF4GII did not affect the α1A mRNA levels. (FIG. 2D, FIG. 2E) miR-3191-5p did not reverse the up-regulating effects of eIF4AII or eIF4GII on CACNA1A IRESmut-driven luciferase activities (FIG. 2D) and on the translation of α1ACT expressed from CACNA1A IRESmut vectors (FIG. 2E). (FIG. 2F) Immunoprecipitation from transfected HEK293 cells with vectors expressing eIF4AII and eIF4GII. (FIG. 2G) The knockdown of eIF4GII showed greater silencing effects on the CACNA1A IRES-driven luciferase activities than eIF4AII. (FIG. 2H) Both eIF4AII and eIF4GII bound to the mRNA transcribed from IRESstopmut-α1ACT vectors that were inhibited by the treatment with miR-3191-5p. Data are means±S.E.M. *P<0.05, P<0.01, *P<0.001. n.s.: not significant; C: control vector; AI: eIF4AI; AII: eIF4AII; GI: eIF4GI; GII: eIF4GII; IgG: control IgG; siC: siRNA control; NC: miRNA negative control; miR-C: miR-control expressing vector; miR-3191: miR-3191-5p expressing vector. Input, 10%.

(FIG. 3A) The co-immunostaining using GFP-specific or FLAG-specific antibodies with staining for calbindin, a Purkinje cell marker. (FIG. 3B) Representative images of immunofluorescence. (FIG. 3C to FIG. 3E) Histopathological features of the cerebellum of mice injected with AAV. The molecular layer thickness (FIG. 3C), the density of dendritic tree (FIG. 3D), and the Purkinje cell count (FIG. 3E) (n=6). (FIG. 3F to FIG. 3H) The clinical symptoms of mice injected with AAV. The body weight (FIG. 3F), rotarod task (FIG. 3G), open field assay (FIG. 3H) (n=12; 6 male and 6 female mice per each group). Data are means±S.E.M. P<0.01 and *P<0.001. n.s.: not significant. Scale bars: (FIG. 3A) and (FIG. 3B), 100 µm.

(FIG. 4A) Representative images of immunofluorescence. (FIG. 4B to FIG. 4D) Histopathological features of the cerebellum of mice injected with AAV. The molecular layer thickness (FIG. 4B), the density of dendritic tree (FIG. 4C), and the Purkinje cell count (FIG. 4D) (n=6). (FIG. 4E to FIG. 4G) The clinical symptoms of mice injected with AAV. The body weight (FIG. 4E), rotarod task (FIG. 4F), open field assay (FIG. 4G) (n=12; 6 male and 6 female mice per each group). WT-GFP: WT-GFP mice; WT-Q33-mock: WT-Q33-miR-mock mice; WT-Q33-3191: WT-Q33-miR-3191-5p mice. Data are means±S.E.M. P<0.01 and *P<0.001. n.s.: not significant. Scale bars: (A), 100 µm.

FIGS. 5A-5C evidence the stem-loop structure of CACNA1A IRES and the predicted binding site of miR-711, -3191-5p, and -4786-3p. (FIG. 5A) The CentroidFold program demonstrated the stem-loop structure of CACNA1A IRES. (FIG. 5B) The miRNA_Targets program showed the predicted binding sites of miR-711, -3191-5p, and -4786-3p. (FIG. 5C) miR-711, -3191-5p, and -4786-3p target the region within CACNA1A IRES between 185 bp and 534 bp upstream from the estimated translational initiation site of α1ACT where we have previously identified an important role in the IRES-driven translation of α1ACT (9).

(FIG. 7A) Western blot analysis showed that miR-3191-5p down-regulated α1ACT-Q11-FLAG expression but spared α1A-Q11-FLAG expression, although miR-711 and -4786-3p did both. (FIG. 7B) miR-711 and -4786-3p down-regulated α1A-Q11 mRNA levels by approximately half relative to a negative control. miR-3191-5p, however, produced no significant change in α1A-Q11 mRNA levels. Data are means±S.E.M. ***P<0.001. n.s.: not significant; NC: miRNA negative control.

FIGS. 8A-8B evidence the preparation of mutated CACNA1A IRES (IRESmut) templates bearing C>G and G>C substitutions within the predicted miR-3191-5p binding site. (FIG. 8A, FIG. 8B) Schematic representations of the original CACNA1A IRES (FIG. 8A) and mutated CACNA1A IRES (IRESmut) templates (FIG. 8B). C>G and G>C substitutions within the predicted miR-3191-5p binding site are shown in lowercases. We also performed C>G and G>C substitutions within the complementary binding site of the sequence targeted by miR-3191-5p, shown in lowercases, to maintain the structure of CACNA1A IRESmut same as that of the original.

(FIG. 10A) Schematic representation of truncated transgenes of CACNA1A second cistron that lack the sequence of 5' up-stream from CACNA1A IRES (IRESstopmut-α1ACT). (FIG. 10B) Western blot analysis showed that the IRESstopmut-α1ACT vectors expressed α1ACT-Q11-FLAG or α1ACT-Q33-FLAG but not full-length α1A-Q11-FLAG or α1A-Q33-FLAG. CACNA1A-Q11, -Q33: vectors expressing CACNA1A-encoded FLAG-tagged peptides (α1A-FLAG and α1ACT-FLAG) with 11Q, -33Q.

(FIG. 11A) Schematic representation of the AAV vectors carrying the truncated transgenes of CACNA1A second cistron that lack the sequence of 5' up-stream from CACNA1A IRES and express either α1ACT-Q11 or -Q33 tagged with a C-terminal FLAG epitope under the control of CACNA1A IRES. (FIG. 11B) Western blot analysis showed the strong expression of GFP, α1ACT-Q11-FLAG, or α1ACT-Q33-FLAG in the brain and cerebellum of WT mice injected with AAV. The continuous expression of GFP, α1ACT-Q11-FLAG, or α1ACT-Q33-FLAG was observed in AAV injected mice at 4 and 12 weeks of age. (FIG. 11C) The expression levels of α1ACT mRNA transcribed from the transgenes delivered by AAV-α1ACT-Q11 or AAV-α1ACT-Q33 into the cerebellum. ITR: inverted terminal repeats; SV40: simian virus 40; polyA: polyadenylation signal sequence; WT-GFP: WT-GFP mice; WT-α1ACT-Q11: WT-α1ACT-Q11 mice; WT-α1ACT-Q33: WT-α1ACT-Q33 mice. Data are means±S.E.M. n.s.: not significant.

FIGS. 12A-12F demonstrate the video-assisted computerized treadmill for the gait analysis of WT mice injected with AAV. (FIG. 12A to FIG. 12F) The Digigait assay revealed that WT-α1ACT-Q33 mice exhibited shorter stride length (FIG. 12A, FIG. 12C, FIG. 12E) and greater stride frequencies (FIG. 12B, FIG. 12D, FIG. 12F) compared to WT-GFP mice and WT-α1ACT-Q11 mice from 4 weeks old (n=12; 6 male and 6 female mice per each group). GFP: WT-GFP mice; Q11: WT-α1ACT-Q11 mice; Q33: WT-α1ACT-Q33 mice; L fore: Left forelimb; R fore: Right forelimb; L hind: Left hindlimb; R hind: Right hindlimb. Data are means±S.E.M. **P<0.01.

(FIG. 13A) Western blot analysis revealed the persistent expression of α1ACT-Q33-FLAG or GFP in the brain and cerebellum of WT mice co-injected with AAV-α1ACT-Q33 and either AAV-miR-mock or AAV-miR-3191-5p, or injected with AAV-GFP for at least 12 weeks. We found the significantly decreased levels of α1ACT-Q33-FLAG expression in the brain and cerebellum of WT-Q33-miR-3191-5p mice as compared to WT-Q33-miR-mock mice. (FIG. 13B) qRT-PCR studies of total RNA showed that the α1ACT-Q33 mRNA levels in the cerebellum of WT-Q33-miR-3191-5p mice were comparable with those of WT-Q33-miR-mock mice. WT-GFP: WT-GFP mice; WT-Q33-mock: WT-Q33-miR-mock mice; WT-Q33-3191: WT-Q33-miR-3191-5p mice. Data are means±S.E.M. n.s.: not significant.

(FIG. 14A to FIG. 14F) The Digigait assay revealed that the treatment with AAV-miR-3191-5p ameliorated the disease phenotypes of shorter stride length (FIG. 14A, FIG. 14C, FIG. 14E) and greater stride frequencies (FIG. 14B, FIG. 14D, FIG. 14F) in WT-Q33-miR-3191-5p mice. GFP: WT-GFP mice; Q33-mock: WT-Q33-miR-mock mice; Q33-3191: WT-Q33-miR-3191-5p mice; L fore: Left forelimb; R fore: Right forelimb; L hind: Left hindlimb; R hind: Right hindlimb. (n=12; 6 male and 6 female mice per each group). Data are means±S.E.M. **P<0.01.

(FIG. 15A to FIG. 15F) Histopathological examination revealed that no obvious morphological anomalies in the brain (FIG. 15A), cerebellum (FIG. 15B), heart (FIG. 15C), lung (FIG. 15D), liver (FIG. 15E), and kidney (FIG. 15F) of the 12 week-old WT mice injected with AAV-miR-3191-5p (WT-miR-3191-5p) compared to age-matched WT mice (WT). Scale bars: (FIG. 15A), 500 μm; and (FIG. 15B) to (F), 200 μm.

FIGS. 16A-16H provide data demonstrating that somatic gene transfer of CACNA1A IRES-driven α1ACTSCA6 causes Purkinje cell degeneration in mice. (FIG. 16A) Representative immunofluorescence images of AAV9-injected mouse brain and cerebellum from 4-week-old mice stained with FLAG-specific antibodies and fluorescent secondary antibody. Scale bar, 5 mm. (FIG. 16B) Relative α1ACT-FLAG immunofluorescence intensities in AAV9-injected mouse hippocampus, cerebral cortex, and cerebellum (n=6). Relative α1ACT-FLAG immunofluorescence is expressed as signal intensities per unit area quantified by the National Institutes of Health (NIH) ImageJ software. n.s., not significant. (FIG. 16C) Relative α1ACT mRNA expression in the cerebellum of AAV9-injected mice at 4 weeks of age (n=4). (FIG. 16D) Western blot and densitometric analyses showing α1ACT-Q11-FLAG and α1ACT-Q33-FLAG expression in the cerebellum of AAV9-injected mice at 4 weeks of age (n=4). (FIG. 16E) Representative immunofluorescence images of AAV9-injected mouse cerebellum from 4-week-old mice stained with calbindin-specific antibodies and fluorescent secondary antibody. Scale bar, 100 μm. (FIG. 16F to FIG. 16H) Molecular layer thickness (FIG. 16F), density of dendritic tree (FIG. 16G), and Purkinje cell count of AAV9-injected mouse cerebellum from 4-week-old mice (n=6) (FIG. 16H). GFP, AAV9-GFP mice; Q11, AAV9-α1ACT-Q11 mice; Q33, AAV9-α1ACT-Q33 mice. All data represent means±SEM. **P<0.01. Student's t test in (B) to (D). One-way analysis of variance (ANOVA) in (FIG. 16F) to (FIG. 16H).

FIGS. 17A-17E provide data demonstrating that CACNA1A IRES-driven α1ACTSCA6 causes an early-onset ataxia and motor deficits in mice. (FIG. 17A to FIG. 17E) Clinical features of AAV9-injected mice. Body weight (FIG. 17A), rotarod test (FIG. 17B), and open-field assay (FIG. 17C) at 4 weeks of age. Stride length (FIG. 17D) and stride frequencies (FIG. 17E) assessed by DigiGait analysis at 4 weeks of age (n=12, 6 male and 6 female mice per group). GFP, AAV9-GFP mice; Q11, AAV9-α1ACT-Q11 mice; Q33, AAV9-α1ACT-Q33 mice. All data represent means±SEM. *P<0.05, **P<0.01. Two-way ANOVA in (FIG. 17A) and (FIG. 17B). One-way ANOVA in (FIG. 17C) to (FIG. 17E).

FIGS. 18A-18G provide data demonstrating that miR-3191-5p inhibits the CACNA1A IRES-driven translation of α1ACT while sparing α1A and CACNA1A mRNA expression in HEK293 cells. (FIG. 18A) Schematic representation of a bicistronic control reporter vector and a bicistronic CACNA1A IRES reporter vector. SV40, simian virus 40; polyA, polyadenylation signal sequence. (FIG. 18B) Relative dual-luciferase CACNA1A IRES reporter activities in HEK293 cells treated with miR-711, miR-3191-5p, miR-4786-3p, or an miRNA negative control (NC) (n=6). The ratio of firefly luciferase to Renilla luciferase activities of a bicistronic CACNA1A IRES reporter vector was normalized to that of a bicistronic control reporter vector. (FIG. 18C and FIG. 18D) Western blot and densitometric analyses showing α1A-FLAG and α1ACT-FLAG expression in HEK293 cells treated with three miRNAs or NC (n=6). (FIG. 18C) CACNA1A-Q11. (FIG. 18D) CACNA1A-Q33. GAPDH, glyceraldehyde-3-phosphate dehydrogenase. (FIG. 18E and FIG. 18F) Relative CACNA1A-Q11 (FIG. 18E) and CACNA1A-Q33 (FIG. 18F) mRNA expression in HEK293 cells treated with three miRNAs or NC (n=6). (FIG. 18G) Relative endogenous CACNA1A mRNA expression in HEK293 cells treated with miR-3191-5p or NC (n=6). All data represent means±SEM. P<0.01, *P<0.001. Student's t test in (FIG. 18B) to (FIG. 18G).

FIGS. 19A-19E provide data demonstrating that Ago4 is required for miR-3191-5p-mediated inhibition of CACNA1A IRES-driven α1ACT translation. (FIG. 19A) Relative dual-luciferase CACNA1A IRES reporter activities in HEK293 cells treated with si-Ago1, si-Ago2, si-Ago3, si-Ago4, or a scrambled control siRNA (si-C) in the presence of miR-3191-5p or an miRNA NC (n=6). The ratio of firefly luciferase to Renilla luciferase activities of a bicistronic CACNA1A IRES reporter vector was normalized to that of a bicistronic control reporter vector. (FIG. 19B) Western blot and densitometric analyses showing α1A-Q33-FLAG and α1ACT-Q33-FLAG expression in HEK293 cells treated with four siRNAs or si-C in the presence of miR-3191-5p or NC (n=6). (FIG. 19C and FIG. 19D) Amount of miR-3191-5p (FIG. 19C) and CACNA1A-Q33 (FIG. 19D) mRNA binding to Ago1 to Ago4 that was immunoprecipitated using antibodies against Ago1 to Ago4 or a control immunoglobulin G (IgG) (n=6). (FIG. 19E) Relative amount of endogenous miR-3191-5p in HEK293 cells treated with si-Ago4 or si-C (n=6). All data represent means±SEM. P<0.01, *P<0.001. Student's t test in (FIG. 19A) to (FIG. 19E).

FIGS. 20A-20L provide data demonstrating that miR-3191-5p inhibits the translational initiation of CACNA1A IRES-driven α1ACT by eIF4AII and eIF4GII. (FIG. 20A to FIG. 20D) Relative dual-luciferase CACNA1A IRES reporter activities in HEK293 cells treated by overexpression of either eIF4AI (AI) (A), eIF4AII (AII) (FIG. 20B), eIF4GI (GI) (FIG. 20C), eIF4GII (GII) (FIG. 20D), or a control vector (FIG. 20C) in the presence of miR-3191-5p or an miRNA NC (n=6). The ratio of firefly luciferase to Renilla luciferase activities of a bicistronic CACNA1A IRES reporter vector was normalized to that of a bicistronic control reporter vector. (FIG. 20E and FIG. 20F) Western blot and densitometric analyses showing α1A-Q33-FLAG and α1ACT-Q33-FLAG expression in HEK293 cells treated by overexpression of either AII (FIG. 20E), GII (FIG. 20F), or C in the presence of miR-3191-5p or NC (n=6). (FIG. 20G and FIG. 20H) Relative CACNA1A-Q33 mRNA expression in HEK293 cells treated by overexpression of either AII (FIG. 20G), GII (FIG. 20H), or C in the presence of miR-3191-5p or NC (n=6). (FIG. 20I and FIG. 20J) Amount of IRES-α1ACT-Q33 mRNA binding to AII (FIG. 20I), GII (FIG. 20J), or a control IgG in the presence of vectors expressing miR-3191-5p (miR-3191) or an miRNA control (miR-C) that was immunoprecipitated using antibodies against AII, GII, or a control IgG (n=6). (FIG. 20K) Immunoprecipitation (IP) from HEK293 cells transfected with AII- and GII-expressing vectors using an antibody against AII, GII, or a control IgG. Recovered proteins were analyzed using Western blot. Input, 10%. (FIG. 20L) Relative dual-luciferase CACNA1A IRES reporter activities in HEK293 cells treated with si-AII, si-GII, or a scrambled si-C (n=6). The ratio of firefly luciferase to Renilla luciferase activities of a bicistronic CACNA1A IRES reporter vector was normalized to that of a bicistronic control reporter vector. All data represent means±SEM. *P<0.05, P<0.01, *P<0.001. Student's t test in (FIG. 20A) to (FIG. 20F), (FIG. 20I), (FIG. 20J), and (FIG. 20L). One-way ANOVA in (FIG. 20G) and (FIG. 20H).

FIGS. 21A-21H data demonstrating that AAV9-mediated therapeutic delivery of miR-3191-5p blocks CACNA1A IRES-driven α1ACT translation in mice. (FIG. 21A and FIG. 21B) Representative immunofluorescence images of AAV9-injected mouse brain and cerebellum from 4-week-old mice stained with GFP-specific (FIG. 21A) and FLAG-specific (FIG. 21B) antibodies and fluorescent secondary antibody. Scale bar, 5 mm. (FIG. 21C and FIG. 21D) Relative GFP (FIG. 21C) and α1ACT-FLAG (FIG. 21D) immunofluorescence intensities in AAV9-injected mouse hippocampus, cerebral cortex, and cerebellum (n=6). Relative GFP and relative FLAG immunofluorescence are expressed as signal intensities per unit area quantified by NIH ImageJ software. (FIG. 21E) Relative α1ACT mRNA expression in the cerebellum of AAV9-injected mice at 4 weeks of age (n=4). (FIG. 21F) Western blot and densitometric analyses showing α1ACT-Q33-FLAG expression in the cerebellum of AAV9-injected mice at 4 weeks of age (n=4). (FIG. 21G and FIG. 21H) Amount of miR-3191-5p (FIG. 21G) and α1ACT-Q33 (FIG. 21H) mRNA binding to Ago4 that was immunoprecipitated using an antibody against Ago4 or a control IgG in the cerebellum of AAV9-Q33-miR-3191-5p mice at 4 weeks of age (n=6). GFP, AAV9-GFP mice; mock, AAV9-Q33-miR-mock mice; 3191, AAV9-Q33-miR-3191-5p mice. All data represent means±SEM. **P<0.01. One-way ANOVA in (FIG. 21C). Student's t test in (FIG. 21D) to (FIG. 21H).

FIGS. 22A-22D provide data demonstrating that miR-3191-5p prevents Purkinje cell degeneration caused by CACNA1A IRES-driven α1ACTSCA6 in mice. (FIG. 22A) Representative immunofluorescence images of AAV9-injected mouse cerebellum from 4-week-old mice stained with calbindin-specific antibodies and fluorescent secondary antibody. Scale bar, 100 μm. (FIG. 22B to FIG. 22D) Molecular layer thickness (FIG. 22B), density of dendritic tree (FIG. 22C), and Purkinje cell counts (FIG. 22D) in AAV9-injected mouse cerebellum from 4-week-old mice (n=6). GFP, AAV9-GFP mice; mock, AAV9-Q33-miR-mock mice; 3191, AAV9-Q33-miR-3191-5p mice. All data represent means±SEM. **P<0.01. Student's t test in (FIG. 22B) to (FIG. 22D).

(FIG. 23A to FIG. 23E) Clinical features of AAV9-injected mice. Body weight (FIG. 23A), rotarod test (FIG. 23B), and open-field assay (FIG. 23C) at 4 weeks of age. Stride length (FIG. 23D) and stride frequencies (FIG. 23E) assessed by DigiGait analysis at 4 weeks of age (n=12, 6 male and 6 female mice per group). GFP, AAV9-GFP mice; mock, AAV9-Q33-miR-mock mice; 3191, AAV9-Q33-miR-3191-5p mice. All data represent means±SEM. *P<0.05, **P<0.01. Two-way ANOVA in (FIG. 23A) and (FIG. 23B). Student's t test in (FIG. 23C) to (FIG. 23E).

FIGS. 24A-24D include a schematic representation of AAV9 vectors and AAV9 transduction efficiency into Purkinje cells. (FIG. 24A) Schematic representation of truncated transgenes of CACNA1A second cistron that lack the sequence of 5' upstream from CACNA1A IRES (IRES-α1ACT). The sequence of nt 4962 to 7757 of full-length CACNA1A cDNA (NM_001127222.1) corresponds to that of CACNA1A IRES and α1ACT open reading frame. The sequence of nt 5013 to 5015 is modified from "TAT" to "TAG" of stop codon. (FIG. 24B) Schematic representations of the AAV9 vectors expressing either CACNA1A IRES-driven α1ACT-Q11 or CACNA1A IRES-driven α1ACT-Q33 tagged with a C-terminal FLAG epitope. ITR: inverted terminal repeats; WPRE: woodchuck hepatitis virus post-transcriptional regulatory element; SV40: simian virus 40; polyA: polyadenylation signal sequence. (FIG. 24C) Representative immunofluorescence images of AAV9-GFP-injected mouse cerebellum from 4-week-old mice co-stained with calbindin-specific and GFP-specific antibodies and fluorescent secondary antibody (scale bars: 100 μm). Phosphate saline buffer (PBS)-injected mice were used as controls. (FIG. 24D) Purkinje cell count of AAV9-injected mouse cerebellum relative to PBS-injected mouse cerebellum (n=6). 75.4±8.9% of calbindin positive cells were positive for GFP staining in the cerebellum of AAV9-GFP mice. Calbindin(+): calbindin positive cells. GFP(+): GFP positive cells.

(FIG. 25A, FIG. 25B) Representative images of (FIG. 25A) cerebral cortex and (FIG. 25B) hippocampus of AAV9-GFP mice, AAV9-α1ACT-Q11 mice, and AAV9-α1ACT-Q33 mice stained with Hematoxylin and eosin. Scale bars: 500 μm in (FIG. 25A) and (FIG. 25B).

FIGS. 26A-26H demonstrate the long-term follow-up of AAV9-injected mouse behavioral phenotypes and CACNA1A IRES-driven α1ACT expression in mice. (FIG. 26A to FIG. 26F) Clinical features of AAV9-injected mice. (FIG. 26A) Rotarod test and (FIG. 26B) open field assay, (FIG. 26C) stride length and (FIG. 26D) stride frequencies assessed by Digigait analysis at 12 weeks of age. (FIG. 26E) Rotarod test and (FIG. 26F) open field assay at 30 weeks of age (n=12: 6 male and 6 female mice per each group). (FIG. 26G) Western blot and densitometric analyses (FIG. 26H) showing α1ACT-FLAG expression in the cerebellum of AAV9-injected mice at 30 weeks of age (n=4). GFP: AAV9-GFP mice; Q11: AAV9-α1ACT-Q11 mice; Q33: AAV9-α1ACT-Q33 mice. All data represent mean±SEM. *P<0.05, **P<0.01. Two-way ANOVA in (FIG. 26A) and (FIG. 26E). One-way ANOVA in (FIG. 26B) to (FIG. 26D), and (FIG. 26F). Student's t-test in (FIG. 26G).

(FIG. 27A) Secondary structure of stem-loop of CACNA1A IRES calculated by the CentroidFold. (B to D) The nucleotide sequence of binding sites of (FIG. 27B) miR-711, (FIG. 27C) miR-3191-5p, and (FIG. 27D) miR-4786-3p within CACNA1A IRES predicted by the miRNA_Targets program.

FIGS. 28A-28E provide data demonstrating the effects of miR-3191-5p on mutated CACNA1A IRES templates. (FIG. 28A, FIG. 28B) Schematic representations of (FIG. 28A) the original CACNA1A IRES and (FIG. 28B) mutated CACNA1A IRES (CACNA1A IRESmut) templates. C>G and G>C substitutions within the predicted miR-3191-5p binding site are shown in lowercase. We also performed C>G and G>C substitutions within the complementary binding site of the sequence targeted by miR-3191-5p, also shown in lowercase, to maintain the stem-loop structure of CACNA1A IRESmut as same as that of the original. (FIG. 28C) Nucleotide sequence of the miR-3191-5p binding site within CACNA1A IRES and CACNA1A IRESmut templates. (FIG. 28D) Relative dual luciferase CACNA1A IRESmut reporter activities in HEK293 cells treated with miR-3191-5p or a miRNA negative control (NC) (n=6). The ratio of firefly luciferase to Renilla luciferase activities of a bicistronic CACNA1A IRESmut reporter vector was normalized to that of a bicistronic control reporter vector. (FIG. 28E) Western blot and densitometric analyses showing α1A-Q33-FLAG and α1ACT-Q33-FLAG expression from CACNA1A IRESmut vectors in HEK293 cells treated with miR-3191-5p or NC (n=6). All data represent mean±SEM. n.s.: not significant. Student's t-test in (FIG. 28D) and (FIG. 28E).

(FIG. 29A, FIG. 29B) Relative dual luciferase CACNA1A IRESmut reporter activities in HEK293 cells treated with over-expression of either (FIG. 29A) eIF4AII (AII), (FIG. 29B) eIF4GII (GII), or a control vector (FIG. 29C) in the presence of miR-3191-5p or a miRNA negative control (NC) (n=6). The ratio of firefly luciferase to Renilla luciferase activities of a bicistronic CACNA1A IRESmut reporter vector was normalized to that of abicistronic control reporter vector. (FIG. 29C, FIG. 29D) Western blot and densitometric analyses showing α1A-Q33-FLAG and α1ACT-Q33-FLAG expression from CACNA1A IRESmut vectors in HEK293 cells treated with over-expression of either (FIG. 29C) AII, (FIG. 29D) GII, or C in the presence of miR-3191-5p or NC (n=6). (FIG. 29E) Schematic diagram of the effect of eIF4AII and eIF4GII on CACNA1A IRES-driven α1ACT translation. The complex of eIF4AII and eIF4GII directly acts on CACNA1A IRES to enhance the initiation of IRES-driven α1ACT translation. (FIG. 29F) Schematic diagram of the inhibitory effect of miR-3191-5p bound to Ago4. miR-3191-5p, in collaboration with Ago4, binds to CACNA1A IRES to inhibit the interaction between CACNA1A IRES and the complex of eIF4AII and eIF4GII. All data represent mean±SEM. P<0.01, *P<0.001. n.s.:not significant. Student's t-test in (FIG. 29A) to (FIG. 29D).

FIGS. 30A-30C provide data demonstrating cotransduction of AAV9-α1ACT-Q33 with either AAV9-miR-mock or AAV9-miR-3191-5p. (FIG. 30A) Schematic representations of the AAV9 vectors expressing GFP with either miR-3191-5p or a scrambled miR (miR-mock). ITR: inverted terminal repats; WPRE: woodchuck hepatitis virus posttranscriptional regulatory element; SV40: simian virus 40; polyA: polyadenylation signal sequence. (FIG. 30B) Representative immunofluorescence images of AAV9-injected mouse cerebellum from 4-week-old mice stained with GFP- and FLAG-specific antibodies and fluorescent secondary antibody (scale bars: 100 μm). (FIG. 30C) The ratio of Purkinje cells stained with both FLAG- and GFP-specific antibodies (both FLAG and GFP positive cells) to those with FLAG-specific antibody (FLAG positive cells). FLAG positive cells were transduced with AAV9-α1ACT-Q33. GFP positive cells were transduced with either AAV9-miR-mock or AAV9-miR-3191-5p (n=6). AAV9-GFP: AAV9-GFP mice; AAV9-Q33-miRmock: AAV9-Q33-miR-mock mice; AAV9-Q33-miR-3191-5p: AAV9-Q33-miR-3191-5p mice. All data represent mean±SEM. n.s.: not significant. Student's t-test in (FIG. 30C).

(FIG. 31A to FIG. 31F) Clinical features of AAV9-injected mice. (A) Rotarod test and (FIG. 31B) open field assay, (FIG. 31C) stride length and (FIG. 31D) stride frequencies assessed by Digigait analysis at 12 weeks of age. (FIG. 31E) Rotarod test and (FIG. 31F) open field assay at 30 weeks of age (n=12: 6 male and 6 female mice per each group). (FIG. 31G) Western blot and densitometric analyses showing α1ACT-Q33-FLAG expression in the cerebellum of AAV9-injected mice at 30 weeks of age (n=4). GFP: AAV9-GFP mice; mock: AAV9-Q33-miR-mock mice; 3191: AAV9-Q33-miR-3191-5p mice. All data represent mean±SEM. *P<0.05, **P<0.01. Two-way ANOVA in (FIG. 31A) and (FIG. 31E). Student's t-test in (FIG. 31B) to (FIG. 31D), (FIG. 31F), and (FIG. 31G).

FIGS. 32A-32H demonstrate the potential mouse mRNAs targeted by human miR-3191-5p. (FIG. 32A) The list of 13 human genes of which 3'UTR has binding sites targeted by hsa-miR-3191-5p predicted by the TargetScanHuman 7.0 (http://www.targetscan.org/vert_70/). Among these, 7 genes (PRX, ZNF781, C22orf46, ZNF23, ZNF286A, ERBB4, PTBP1) have hsa-miR-3191-5p binding sites within 3'UTR of their conserved mouse orthologs. (FIG. 32B to FIG. 32H) Relative expression of the mouse (FIG. 32B) Prx, (FIG. 32C) Zfp781, (FIG. 32D) 4930407I10Rik, (FIG. 32E) Zfp612, (FIG. 32F) Zfp286, (FIG. 32G) Erbb4, and (FIG. 32H) Ptbp1 mRNAs in the cerebellum of AAV9-injected mice (n=4). N/A: not assigned; WT, mock: wildtype mice injected with AAV9-miR-mock; WT, 3191: wild-type mice injected with AAV9-miR-3191-5p. All data represent mean±SEM. *P<0.05. n.s.: not significant. Student's t-test in (FIG. 32B) to (FIG. 32H).

FIGS. 33A-33H demonstrate a histopathological examination of the brain, cerebellum, heart, lung, liver, and kidney of wild-type mice injected with AAV9-miR-3191-5p. (FIG. 33A to FIG. 33F) Histopathological examination of the (FIG. 33A) brain, (FIG. 33B) cerebellum, (FIG. 33C) heart, (FIG. 33D) lung, (FIG. 33E) liver, and (FIG. 33F) kidney of the 12-week-old wild-type mice injected with AAV-miR3191-5p (WT-miR-3191-5p) compared to age-matched wild-type mice (WT). All were stained with Hematoxylin and eosin. Scale bars: (FIG. 33A), 500 µm; and (FIG. 33B) to (FIG. 33F), 200 µm.

DETAILED DESCRIPTION

Spinocerebellar ataxia Type 6 (SCA6)

Figure 3A:
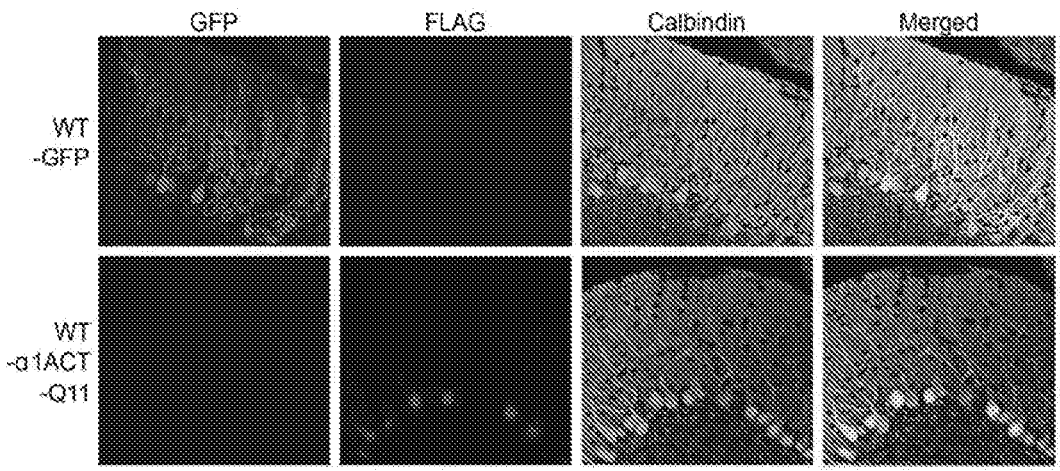
FIGS. 3A-3H demonstrate the physiological and pathological effects of AAV-mediated delivery of either α1ACT$_{WT}$ or α1ACT$_{SCA6}$ into the WT neonatal mice.
Figure 3B:
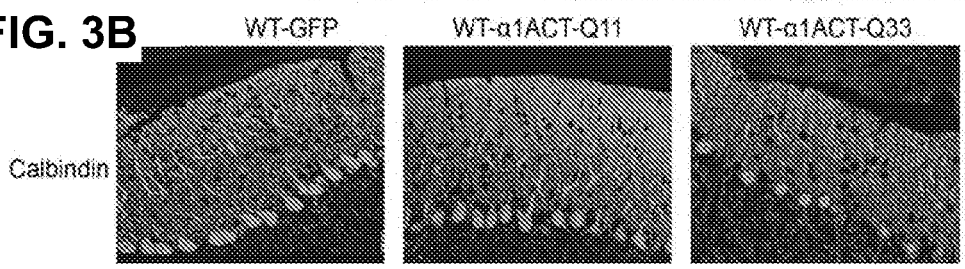
Figure 3C:
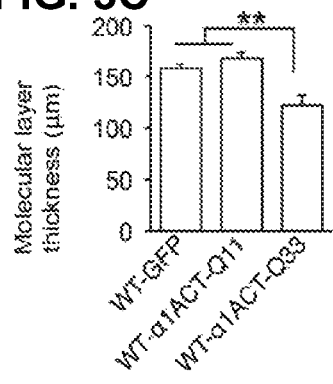
Figure 3D:
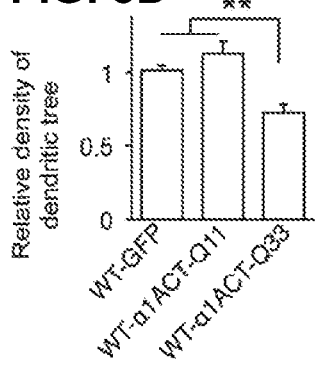
Figure 3E:
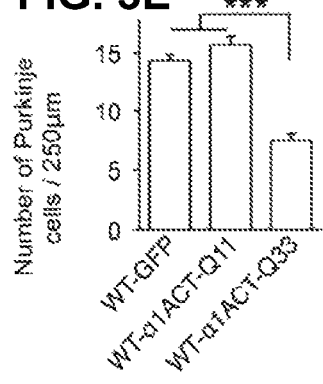

SCA6 is a neurodegenerative disease (polyQ disorders) caused by expansion of a polyglutamine (polyQ) tract. In SCA6, the polyQ tract expansion is encoded by the $47^{th}$ exon of the CACNA1A gene. In exemplary aspects, the normal range of polyQ tracts is 4-18, whereas the pathological range of polyQ tracts is 19-33.

The principal gene product of CACNA1A is the α1A subunit of the P/Q-type voltage-gated $Ca^{2+}$ channel. Voltage-gated calcium channel genes encode a large family of channel proteins (α1 subunits) that play critical roles in neuronal excitability, transmitter release, muscle contractility and gene expression (Catterall, Cold Spring Harbor Perspect. Biol. 3, a003947 (2011)). Genetic defects of these channels have been implicated in a variety of neurological, cardiac and skeletal muscle disorders (Cain and Snutch, Biofactors 37: 197-205 (2011)). Diverse mutations in the α1A subunit, CACNA1A gene, causing either loss or gain of P/Q-type channel function, have been associated with dominantly inherited conditions of migraine, epilepsy, and episodic and progressive ataxia (Rajakulendran et al., Nat. Rev. Neurol. 8: 86-96 (2012)). CACNA1A mutations of several types, leading to both loss and gain of channel function, are responsible for several types of neurological diseases, including episodic ataxia type 2, familial hemiplegic migraine, and epilepsy (Jen J, et al., Neurology. 2004; 62:17-22; Spacey S D, Materek L A, Szczygielski B I, Bird T D. 2005; 62(2):314-6; Roubertie A, et al., J Neurol. 2008; 255(10):1600-2).

The presence of the CAG repeat encoding a polyQ tract in the C terminus of the α1A subunit led to the obvious hypothesis that the polyQ expansion in SCA6 caused a pathological disturbance of P/Q channel function (Kordasiewicz H B, et al., 2007; 4(2):285-94; Lory P, et al., IDrugs. 2010; 13(7):467-71). However, several in vitro and in vivo expression studies have failed to demonstrate a consistent effect on channel function (Matsuyama Z, et al., J. Neurosci. 1999; RC14:1-5; Restituito S, et al., J. Neurosci. 2000; 20(17):6394-403; Toru S, et al., Journal of Biological Chemistry. 2000; 275(15):10893-8; Piedras-Renteria E S, et al., J Neurosci. 2001; 21(23):9185-93; Chen H, Piedras-Renteria E S. 2007; 292(3):C1078-86). In particular, two separate studies using CACNA1A knock-in mice with SCA6 repeat expansions failed to demonstrate any change in P/Q channel gating properties in cerebellar neurons (Saegusa H, et al., Mol Cell Neurosci. 2007; 34(2):261-70; Watase K, et al., Proc Natl Acad Sci USA. 2008; 105(33):11987-92). Therefore, it is unlikely that SCA6 is a "channelopathy" in the classical sense. That SCA6 was attributed to expansion of polyQ tracts added further complexity to modeling both channel function and disease pathogenesis (Zhuchenko et al., Nat. Genet. 15:62-69 (1997)).

Evidence provided herein suggests that the disease is attributable to expression of a polyQ repeat expansion within a second CACNA1A gene product, α1ACT, that normally serves as a transcription factor (TF) critical for cerebellar cortical development. α1ACT is a C-terminal peptide encoded by the α1A mRNA. SCA6-sized polyQ expansions in the α1ACT TF interrupt its cellular and molecular function, and several studies have shown toxicity of α1ACT with SCA6-sized polyQ expansions in models. Several laboratories have shown that α1ACT, which contains the polyQ tract, is present as a stable fragment in cultured cells or cerebellar tissues (Scott V E, et al., J Neurosci. 1998; 18(2):641-7; Kubodera et al. Neurosci Lett. 2003; 341(1):74-8; Kordasiewicz et al., Hum Mol Genet. 2006; 15(10):1587-99; Marqueze-Pouey et al., Traffic. 2008; 9(7):1088-100; Ishiguro et al., Acta Neuropathol. 2010; 119(4):447-64). This fragment is enriched in cerebellar nuclei, translocated based on nuclear localization signals in the α1ACT sequence (Kordasiewicz et al., supra). Finally, several groups have shown that the α1ACT fragment bearing SCA6-expanded polyQs, unlike the full-length α1A subunit, is toxic to cultured cells or primary neurons (Kubodera et al. Neurosci Lett. 2003; 341(1):74-8; Kordasiewicz et al., Hum Mol Genet. 2006; 15(10):1587-99; Marqueze-Pouey et al., Traffic. 2008; 9(7):1088-100; Ishiguro et al., Acta Neuropathol. 2010; 119(4):447-64).

As shown herein, α1ACT arises from a gene regulatory mechanism, that is novel for the CACNA1A gene and for ion channel genes in general, in which expression of α1ACT is under the control of a cryptic cellular internal ribosomal entry site (IRES) within the CACNA1A gene coding region. Based on the data herein, it is hypothesized that the cellular IRES-regulated α1ACT is required for Purkinje cell development, and that the polyQ-expanded variant, α1ACT$_{SCA6}$, leads to neurodegeneration.

Based at least in part on the data presented herein, the invention provides a method of treating SCA6 in a subject in need thereof. In exemplary embodiments, the method comprises the step of administering to the subject an IRES inhibitor in an amount effective for treating the SCA6 in the subject.

The invention also provides a method of treating a subject with a predisposition to spinocerebellar ataxia Type 6 (SCA6). In exemplary embodiments, the method comprises the step of administering to the subject an IRES inhibitor in amount effective for delaying development of SCA6 in the subject. In exemplary aspects, the subject with a predisposition to SCA6 is a subject who has a family history of SCA6. In exemplary aspects, the subject with a predisposition to SCA6 is a subject who has a parent suffering from SCA6. In exemplary aspects, the subject with a predisposition to SCA6 is a subject who has one copy of the altered CACNA1A gene having a number of polyQ tracts in the pathological range. In exemplary aspects, the subject is one who has a number of polyQ tracts in the $47^{th}$ exon of the CACNA1A gene which is considered pathological (e.g., 19 or more polyQ tracts).

In exemplary aspects, the subject is a subject who has more than 10 (e.g., more than 11, 12, 13, 14, 15, 16, 17, 18) polyQ tracts in the $47^{th}$ exon of the CACNA1A gene. In exemplary aspects, the subject is a subject who has more than 15 (e.g., 16, 17, 18) polyQ tracts in the $47^{th}$ exon of the CACNA1A gene.

In exemplary aspects, the method of treating a subject with SCA6 or a predisposition to SCA6 comprises administering to the subject (i) an antisense molecule that binds to a portion of an IRES of a CACNA1A gene comprising the sequence of SEQ ID NO: 180, optionally, wherein the antisense molecule binds to Argonaute 4 (Ago4), (ii) a vector encoding the antisense molecule, (iii) a cell comprising the vector or anti sense molecule, (iv) a extracellular vesicle comprising the antisense molecule, or (v) a combination thereof. Optionally, the vector is a recombinant expression vector of as described herein, the cell is a cell as described herein, or the extracellular vesicle is an extracellular vesicle as described herein. In exemplary aspects, the antisense molecule comprises the sequence of SEQ ID NO: 179. In exemplary aspects, the vector is a recombinant adeno-associated viral (AAV) vector, e.g., an AAV serotype 9 (AAV9) vector. In exemplary aspects, the recombinant AAV vector comprises one or more of a promoter, a pair of inverted terminal repeats (ITRs), and a polyadenylation signal sequence. In exemplary aspects, the promoter is a human cytomegalovirus (CMV) immediate early promoter. In exemplary aspects, the ITRs are AAV ITRs. In exemplary aspects, the polyadenylation signal sequence is an simian virus 40 (SV40) polyadenylation signal sequence. In exemplary aspects, the recombinant expression vector comprises a woodchuck hepatitis virus posttranscriptional regulatory element (WPRE). In exemplary aspects, the recombinant expression vector comprises an ITR upstream of the human CMV immediate early promoter, which is located upstream of the nucleotide sequence encoding the antisense molecule, which is located upstream of the WPRE which is located upstream of the SV40 polyadenylation signal sequence which is located upstream of the the other ITR.

The term "treat" as well as words stemming therefrom, as used herein, do not necessarily imply 100% or complete treatment. Rather, there are varying degrees of treatment of which one of ordinary skill in the art recognizes as having a potential benefit or therapeutic effect. In this respect, the inventive methods can provide any amount, level, or degree of treatment in a subject. Furthermore, the treatment provided by the methods of the invention may include treatment of one or more conditions or symptoms or signs of the genetic disease, trinucleotide repeat disorder, polyQ disease, or SCA6 being treated. For example, the method of the invention may address one or more of: episodes of ataxia, vertigo and/or osscilopsia, diplopia, REM sleep disorders, dysarthria, dysphagia, ambulation and mobility difficulties, sleep apnea, ataxia, speech difficulties, involuntary eye movements (nystagmus), double vision, loss of coordination in their arms, tremors, uncontrolled muscle tensing (dystonia), severe incapacitation, aspiration pneumonia or respiratory failure. Also, the treatment provided by the methods of the invention may encompass slowing the progression of the disease or disorder. For example, the treatment may slow the progression of one or more of: episodes of ataxia, vertigo and/or osscilopsia, diplopia, REM sleep disorders, dysarthria, dysphagia, ambulation and mobility difficulties, sleep apnea, ataxia, speech difficulties, involuntary eye movements (nystagmus), double vision, loss of coordination in their arms, tremors, uncontrolled muscle tensing (dystonia), severe incapacitation, aspiration pneumonia or respiratory failure.

Accordingly, the invention provides methods of inhibiting or preventing Purkinje cell degeneration in a subject. The invention also accordingly provides methods of inhibiting or preventing ataxia in a subject. In exemplary embodiments, the methods comprise administering to the subject (i) an antisense molecule that binds to a portion of an IRES of a CACNA1A gene comprising the sequence of SEQ ID NO: 180, optionally, wherein the antisense molecule binds to Argonaute 4 (Ago4), (ii) a vector encoding the antisense molecule, (iii) a cell comprising the vector or antisense molecule, (iv) a extracellular vesicle comprising the antisense molecule, or (v) a combination thereof. Optionally, the vector is a recombinant expression vector of as described herein, the cell is a cell as described herein, or the extracellular vesicle is an extracellular vesicle as described herein. In exemplary aspects, the antisense molecule comprises the sequence of SEQ ID NO: 179. In exemplary aspects, the vector is a recombinant adeno-associated viral (AAV) vector, e.g., an AAV serotype 9 (AAV9) vector. In exemplary aspects, the recombinant AAV vector comprises one or more of a promoter, a pair of inverted terminal repeats (ITRs), and a polyadenylation signal sequence. In exemplary aspects, the promoter is a human cytomegalovirus (CMV) immediate early promoter. In exemplary aspects, the ITRs are AAV ITRs. In exemplary aspects, the polyadenylation signal sequence is an simian virus 40 (SV40) polyadenylation signal sequence. In exemplary aspects, the recombinant expression vector comprises a woodchuck hepatitis virus posttranscriptional regulatory element (WPRE). In exemplary aspects, the recombinant expression vector comprises an ITR upstream of the human CMV immediate early promoter, which is located upstream of the nucleotide sequence encoding the antisense molecule, which is located upstream of the WPRE which is located upstream of the SV40 polyadenylation signal sequence which is located upstream of the the other ITR.

Polyglutamine (PolyQ) Diseases

Because SCA6 is a polyQ disease, the steps of the methods of treating SCA6 provided herein are proposed as being useful in the treatment of other polyQ diseases. Accordingly, the invention provides methods of treating a polyglutamine (PolyQ) disease in a subject in need thereof. In exemplary embodiments, the methods comprise the step of administering to the subject an IRES inhibitor in an amount effective for treating the polyQ disease in the subject. In exemplary embodiments, the methods comprise administering to the subject (i) an antisense molecule that binds to a portion of an IRES of a CACNA1A gene comprising the sequence of SEQ ID NO: 180, optionally, wherein the antisense molecule binds to Argonaute 4 (Ago4), (ii) a vector encoding the antisense molecule, (iii) a cell comprising the vector or antisense molecule, (iv) a extracellular vesicle comprising the antisense molecule, or (v) a combination thereof. Optionally, the vector is a recombinant expression vector of as described herein, the cell is a cell as described herein, or the extracellular vesicle is an extracellular vesicle as described herein. In exemplary aspects, the antisense molecule comprises the sequence of SEQ ID NO: 179. In exemplary aspects, the vector is a recombinant adeno-associated viral (AAV) vector, e.g., an AAV serotype 9 (AAV9) vector. In exemplary aspects, the recombinant AAV vector comprises one or more of a promoter, a pair of inverted terminal repeats (ITRs), and a polyadenylation signal sequence. In exemplary aspects, the promoter is a human cytomegalovirus (CMV) immediate early promoter. In exemplary aspects, the ITRs are AAV ITRs. In exemplary aspects, the polyadenylation signal sequence is an simian virus 40 (SV40) polyadenylation signal sequence. In exemplary aspects, the recombinant expression vector comprises a woodchuck hepatitis virus posttranscriptional regulatory element (WPRE). In exemplary aspects, the recombinant expression vector comprises an ITR upstream of the human CMV immediate early promoter, which is located upstream of the nucleotide sequence encoding the antisense molecule, which is located upstream of the WPRE which is located upstream of the SV40 polyadenylation signal sequence which is located upstream of the the other ITR.

As used herein, the term "polyQ disease" refers to a trinucleotide repeat disorder in which the codon CAG is repeated in the coding region of a gene resulting in a polyQ tract beyond a normal or standard. PolyQ diseases known to date include those listed in the table below.

| PolyQ Disease | Gene | No. of PolyQ repeats in Normal State | No. of PolyQ repeats in Pathogenic State |
|---|---|---|---|
| DRPLA (Dentatorubro-pallidoluysian atrophy) | ATN1 or DRPLA | 6-35 | 49-88 |
| HD (Huntington's disease) | HTT (Huntingtin) | 10-35 | 35+ |
| SBMA (Spinobulbar muscular atrophy or Kennedy disease) | Androgen receptor on the X chromosome. | 9-36 | 38-62 |
| SCA1 (Spinocerebellar ataxia Type 1) | ATXN1 | 6-35 | 49-88 |
| SCA2 (Spinocerebellar ataxia Type 2) | ATXN2 | 14-32 | 33-77 |
| SCA3 (Spinocerebellar ataxia Type 3 or Machado-Joseph disease) | ATXN3 | 12-40 | 55-86 |
| SCA6 (Spinocerebellar ataxia Type 6) | CACNA1A | 4-18 | 21-30 |
| SCA7 (Spinocerebellar ataxia Type 7) | ATXN7 | 7-17 | 38-120 |
| SCA17 (Spinocerebellar ataxia Type 17) | TBP | 25-42 | 47-63 |

Source: "Trinucleotide repeat disorder" on Wickipedia, 2013

Besides being encoded by a gene comprising repeated CAG codons, the polyQ proteins involved in polyQ diseases have no structural similarity otherwise. Several polyQ proteins have nuclear functions relating to gene regulation (Riley B E, et al., Genes Dev. 2006; 20(16):2183-92). Toxicity in these disorders depends on the flanking protein context of the polyQ tract, and is frequently associated with transport to the nucleus of the full length or a toxic fragment of the mutant protein (La Spada A R, et al. Curr Med Chem. 2010; 17(27):3058-68, Robertson et al., Curr Med Chem (2010) 17(27): 3058-3068).

Neurodegenerative Diseases (ND)

Neurodegenerative diseases are defined as hereditary and sporadic conditions which are characterized by progressive nervous system dysfunction. These disorders are often associated with atrophy of the affected central or peripheral structures of the nervous system. They include diseases such as Alzheimer's Disease and other dementias, Brain Cancer, Degenerative Nerve Diseases, Encephalitis, Epilepsy, Genetic Brain Disorders, Head and Brain Malformations, Hydrocephalus, Stroke, Parkinson's Disease, Multiple Sclerosis, Amyotrophic Lateral Sclerosis (ALS or Lou Gehrig's Disease), Huntington's Disease, Prion Diseases, and others.

There are extensive overlaps between SCA and other neurodegenerative diseases (NDs) (Shao J, Diamond M I. Hum Mol Genet. 2007; 16 Spec No. 2:R115-23; Bauer P O, Nukina N. J Neurochem. 2009; 110(6):1737-65; La Spada A R, Taylor J P. Nat Rev Genet. 2010; 11(4):247-58; He X H, Lin F, Qin Z H. Neurosci Bull. 2010; 26(3):247-56). Although neuronal cell loss is most evident in the regions responsible for the principal clinical presentation of NDs, neurodegeneration is nearly always more widespread (Gomez C M, et al. Ann Neurol. 1997; 42(6):933-50; Koeppen A H. Journal of Neuropathology & Experimental Neurology. 1998; 57(6):531-43; Havel L S et al. Mol Brain. 2009; 2:21; Pula J H, et al., 2011; 35(3):108-14). Moreover, there is an increasing overlap in possible disease mechanisms. For example, there are growing mechanistic genetic overlaps between ALS and SCA2 (24) and SCA6 and epilepsy (Yalcin 0. Seizure. 2011, Rajakulendran S, et al., 2012). Thus, insights into molecular pathogenesis in each disease will have a wider impact on understanding neuronal death and dysfunction in other systems.

The steps of the method of treating SCA6 provided herein are proposed as being useful in the treatment of other neurodegenerative diseases. Accordingly, the invention provides methods of treating a neurodegenerative disease. In exemplary aspects, the method comprises the step of administering to the subject an IRES inhibitor in an amount effective for treating the neurodegenerative disease. In exemplary aspects, the neurodegenerative disease is episodic ataxia type 2, familial hemiplegic migraine, and epilepsy, Alzheimer's Disease and other dementias, Brain Cancer, Degenerative Nerve Diseases, Encephalitis, Epilepsy, Genetic Brain Disorders, Head and Brain Malformations, Hydrocephalus, Stroke, Parkinson's Disease, Multiple Sclerosis, Amyotrophic Lateral Sclerosis (ALS or Lou Gehrig's Disease), Huntington's Disease, Prion Diseases, and others. In exemplary aspects, the neurodegenerative disease is SCA6.

In exemplary embodiments, the methods comprise administering to the subject (i) an antisense molecule that binds to a portion of an IRES of a CACNA1A gene comprising the sequence of SEQ ID NO: 180, optionally, wherein the antisense molecule binds to Argonaute 4 (Ago4), (ii) a vector encoding the antisense molecule, (iii) a cell comprising the vector or antisense molecule, (iv) a extracellular vesicle comprising the antisense molecule, or (v) a combination thereof. Optionally, the vector is a recombinant expression vector of as described herein, the cell is a cell as described herein, or the extracellular vesicle is an extracellular vesicle as described herein. In exemplary aspects, the antisense molecule comprises the sequence of SEQ ID NO: 179. In exemplary aspects, the vector is a recombinant adeno-associated viral (AAV) vector, e.g., an AAV serotype 9 (AAV9) vector. In exemplary aspects, the recombinant AAV vector comprises one or more of a promoter, a pair of inverted terminal repeats (ITRs), and a polyadenylation signal sequence. In exemplary aspects, the promoter is a human cytomegalovirus (CMV) immediate early promoter. In exemplary aspects, the ITRs are AAV ITRs. In exemplary aspects, the polyadenylation signal sequence is an simian virus 40 (SV40) polyadenylation signal sequence. In exemplary aspects, the recombinant expression vector comprises a woodchuck hepatitis virus posttranscriptional regulatory element (WPRE). In exemplary aspects, the recombinant expression vector comprises an ITR upstream of the human CMV immediate early promoter, which is located upstream of the nucleotide sequence encoding the antisense molecule, which is located upstream of the WPRE which is located upstream of the SV40 polyadenylation signal sequence which is located upstream of the the other ITR.

IRES Inhibitors

The methods of the invention comprise the step of administering to a subject an IRES inhibitor. As used herein, the term "IRES" is synonymous with "internal ribosome entry site" and refers to a nucleotide sequence that allows for the initiation of translation in the middle of a messenger ribonucleic acid (mRNA) sequence as part of the greater process of protein synthesis. IRES-mediated translation in exemplary embodiments is considered as "cap-independent" translation. In exemplary aspects, the IRES is located in the 5' untranslated region (5' UTR) of a gene. In alternative aspects, the IRES is located within the middle of a mRNA.

As used herein, the term "IRES inhibitor" refers to any compound that inhibits IRES-mediated activity, e.g., IRES-mediated translation of an mRNA or IRES protein binding. In exemplary embodiments, the IRES inhibitor is a nucleic acid, a nucleic acid analog, a peptide, a polypeptide, a peptidomimetic, a peptoid, a small molecular weight compound, or the like. In exemplary aspects, the IRES inhibitor is an antisense molecule that binds to mRNA produced by a gene which gene is known to be causative of a particular disease. In exemplary aspects, the antisense molecule is an antisense oligonucleotide comprising deoxyribonucleic acid (DNA) and/or ribonucleic acid (RNA). In exemplary aspects, the antisense molecule is an antisense nucleic acid analog comprising a structural analog of DNA and/or RNA. In exemplary aspects, the antisense molecule is synthetic. As used herein, the term "synthetic" refers to a manufactured or engineered compound or molecule which does not occur or exist in nature. In alternative exemplary aspects, the IRES inhibitor is a small molecular weight compound having a molecular weight of less than about 10 kDa, as measured by, for example, gel filtration chromatography. One skilled in the art will appreciate that a small molecular weight compound can be a non-peptidic compound that is cell-permeable and resistant to degradation. The term "non-peptidic" as used herein refers to not being derived from a protein. The IRES inhibitor may be natural, synthetic, or semi-synthetic or partially synthetic.

The IRES inhibitor may inhibit any one or more of IRES-mediated activities. In exemplary aspects, the IRES inhibitor inhibits IRES-mediated translation of an mRNA and/or IRES-mediated protein binding. For example, the IRES inhibitor may be a compound which blocks the binding of an IRES trans-acting factor (ITAF) to an IRES. In exemplary aspects, the IRES inhibitor binds to or adjacent to the IRES and effectively blocks the binding of the ITAF to the IRES. In alternative aspects, the IRES inhibitor binds to the ITAF and blocks the binding of the ITAF to the IRES. The IRES inhibitor may binds to the ITAF within or adjacent to the IRES-binding site of the ITAF, thereby blocking the ITAF's ability to bind to the IRES.

In additional or alternative embodiments, the IRES inhibitor blocks translation of an mRNA through additional or alternative mechanisms. In exemplary aspects, the IRES inhibitor alters the primary, secondary, and/or tertiary structure of the IRES. In exemplary aspects, the IRES inhibitor effects the change in structure of the IRES by cleaving within the IRES or modifying the chemico-physico attributes of the IRES.

The IRES inhibitor may provide any level of inhibition of IRES-mediated activity. In exemplary aspects, the IRES inhibitor inhibits at least 10% IRES-mediated activity. In exemplary aspects, the IRES inhibitor achieves at least a 50% inhibition of IRES-mediated activity. In exemplary aspects, the IRES inhibitor achieves at least a 90% inhibition of IRES-mediated activity. In exemplary aspects, the IRES inhibitor inhibits at least 10% IRES-mediated translation. In exemplary aspects, the IRES inhibitor achieves at least a 50% inhibition of IRES-mediated translation. In exemplary aspects, the IRES inhibitor achieves at least a 90% inhibition of IRES-mediated translation. Methods of testing IRES-mediated translation, and thus, methods of inhibiting IRES-mediated translation, are known in the art. See, for example, Du et al., Cell 154: 118-133 (2013) and Examples 1 and 2 herein. In exemplary aspects, methods of testing the inhibition of IRES-mediated translation comprises use of one or more bi-cistronic reporter constructs. In exemplary aspects, the IRES inhibitor inhibits at least 10% IRES-mediated protein binding, e.g., IRES-protein binding. In exemplary aspects, the IRES inhibitor achieves at least a 50% inhibition of IRES-protein binding. In exemplary aspects, the IRES inhibitor achieves at least a 90% inhibition of IRES-protein binding. Methods of testing levels of IRES-protein binding are known in the art and include for example electrophoretic mobility shift assay (EMSA). See, e.g., Ausubel, Frederick M. (1994). Current Protocols in molecular biology. Chichester: John Wiley & Sons. pp. 12.2.1-11, and Example 1 herein.

In exemplary aspects, the IRES inhibitor targets an IRES within a viral genome. In exemplary aspects, the IRES inhibitor does not target an IRES within a viral genome. IRESs found within a viral genome are known in the art and include, for example, a picornavirus IRES, aphthovirus IRES, Hepatitis A IRES, Hepatitis C IRES, Pestivirus IRES, Cripavirus IRES, Kaposi's sarcoma associated herpesvirus IRES, and the Marek's disease virus IRES. The IRES inhibitor in exemplary aspects targets an IRES within a poliovirus genome, a rhinovirus genome, an encephalomyocarditis virus genome, a foot-and-mouth disease virus genome, a Hepatitis A virus genome, a Hepatitis C virus genome, a classical swine fever virus genome, a bovine viral diarrhea virus genome, a friend murine leukemia virus genome, a Moloney murine leukemia virus genome, a Rous sarcoma virus genome, a Human immunodeficiency virus genome, a Plautia stali intestine virus genome, a Rhopalosiphum padi virus genome, a Cricket paralysis virus genome, a Triatoma virus genome, a Kaposi's sarcoma associated herpes virus genome, or a Marek's disease virus genome.

In exemplary aspects, the IRES inhibitor targets an IRES within a cellular mRNA. In exemplary aspects, the IRES inhibitor does not target an IRES within a cellular mRNA. In exemplary aspects, the cellular mRNA encodes a growth factor, a transcription factor, a translation factor, an oncogene, a transporter, a receptor, an activator of apoptosis, or a protein localized in neuronal dendrites. In exemplary aspects, the IRES inhibitor targets or does not target an mRNA encoding any one or more of the following proteins: Fibroblast growth factor (FGF-1, FGF-2), Platelet-derived growth factor B (PDGF/c-sis), Vascular endothelial growth factor (VEGF), Insulin-like growth factor 2 (IGF-II), the Antennapedia, Ultrabithorax, MYT-2, NF-κB repressing factor NRF, AML1/RUNX1, Gtx homeodomain protein, Eukaryotic initiation factor 4G (eIF4G)a, Eukaryotic initiation factor 4G1 (eIF4G1)a, Death associated protein 5 (DAPS), c-myc, L-myc, Pim-1, Protein kinase p58PITSLRE, p53, Cationic amino acid transporter Cat-1, Nuclear form of Notch 2, Voltage-gated potassium channel, Apoptotic protease activating factor (Apaf-1), X-linked inhibitor of apoptosis (XIAP), HIAP2, Bcl-xL, Bcl-2, Activity-regulated cytoskeletal protein (ARC), α-subunit of calcium calmodulin dependent kinase II dendrin, Microtubule-associated protein 2 (MAP2), neurogranin (RC3), Amyloid precursor protein, Immunoglobulin heavy chain binding protein (BiP), Heat shock protein 70, β-subunit of mitochondrial H+-ATP synthase, Ornithine decarboxylase, connexins 32 and 43, HIF-1a, APC.

In exemplary aspects, the IRES inhibitor targets the IRES of a gene associated with a diseased state. In exemplary aspects, the IRES inhibitor targets the IRES of a gene associated with a genetic disorder, e.g., a trinucleotide repeat disorder. In exemplary aspects, the IRES inhibitor targets the IRES of a gene associated with a polyglutamine disease. Genes associated with a polyQ disease are described herein. See, e.g., the table in the section entitled "Polyglutamine Diseases."

In exemplary aspects, the IRES inhibitor targets the IRES of an mRNA encoding a calcium channel or a transcription factor. In exemplary aspects, the IRES inhibitor targets the IRES of a bi-cistronic mRNA encoding both a calcium channel and a transcription factor. In exemplary aspects, the IRES inhibitor targets the IRES of the α1A mRNA, which is encoded by the CACNA1A gene. The CACNA1A gene, officially named as the calcium channel, voltage-dependent, P/Q type, alpha 1A subunit gene, is described in the Gene database of the National Center for Biotechnology Information (NCBI) as Gene ID 773. The gene encodes 5 isoforms of the α1A protein, a voltage-gated calcium channel subunit. Each are provided in the GenBank database as follows: α1A Isoform 1 (NP_000059); α1A Isoform 2 (NP_075461.2), α1A Isoform 3 (NP_001120693.1), α1A Isoform 4 (NP_001120694.1), and α1A Isoform 5 (NP_001167551.1). While the IRES is present in all five isoforms, the mRNA encoding Isoforms 1, 3, and 5 do not have the polyQ tract, whereas the mRNA encoding Isoforms 2 and 4 comprise the polyQ tract. In exemplary aspects, the IRES inhibitor targets the IRES of the mRNA of the α1A Isoform 2 or of the α1A Isoform 4. The CACNA1A gene also encodes the α1ACT protein, a transcription factor that coordinates expression of a program of genes involved in neural and Purkinje cell development. The sequence of the nucleic acid encoding the α1ACT protein is known in the art and is set forth herein as SEQ ID NO: 4.

In exemplary aspects, the IRES inhibitor blocks binding of the IRES of the α1A mRNA to an IRES ITAF which binds to the IRES of the α1A mRNA. In exemplary aspects, the IRES inhibitor binds to an ITAF that binds to the IRES of the α1A mRNA. In exemplary aspects, the IRES inhibitor binds to or adjacent to the IRES of the α1A mRNA.

In exemplary aspects, the IRES inhibitor is an antisense molecule which permits specific suppression or reduction of expression of the nucleic acid (e.g., the mRNA) encoding the α1ACT protein. In exemplary aspects, the IRES inhibitor is an antisense molecule which permits specific suppression or reduction of expression of the nucleic acid (e.g., the mRNA) encoding the α1ACT protein without affecting the expression of the nucleic acid of the α1A protein. In exemplary aspects, the IRES inhibitor causes specific suppression of translation of the nucleic acid (e.g., the mRNA) encoding the α1ACT protein without causing degradation of the α1A mRNA and/or without inhibition of expression of the α1A protein.

In exemplary aspects, the antisense molecule can be complementary to the entire coding region of the nucleic acid encoding the α1ACT protein (SEQ ID NO: 4), or to a portion thereof. The antisense molecule in exemplary aspects is about 5, about 10, about 15, about 20, about 25, about 30, about 35, about 40, about 45 or about 50 nucleotides in length.

In exemplary aspects, the antisense molecule is about X to about Y nucleotides in length, wherein X is 10, 11, 12, 13, 14, or 15 and Y is 20, 21, 22, 23, 24, 25, 26, 27, 28, 29, or 30. In exemplary aspects, the antisense molecule is about 10 to about 20 nucleotides in length, about 10 to about 21 nucleotides in length, about 10 to about 22 nucleotides in length, about 10 to about 23 nucleotides in length, about 10 to about 24 nucleotides in length, about 10 to about 25 nucleotides in length, about 10 to about 26 nucleotides in length, about 10 to about 27 nucleotides in length, about 10 to about 28 nucleotides in length, about 10 to about 29 nucleotides in length, or about 10 to about 30 nucleotides in length. In exemplary aspects, the antisense molecule is about 11 to about 20 nucleotides in length, about 11 to about 21 nucleotides in length, about 11 to about 22 nucleotides in length, about 11 to about 23 nucleotides in length, about 11 to about 24 nucleotides in length, about 11 to about 25 nucleotides in length, about 11 to about 26 nucleotides in length, about 11 to about 27 nucleotides in length, about 11 to about 28 nucleotides in length, about 11 to about 29 nucleotides in length, or about 11 to about 30 nucleotides in length. In exemplary aspects, the antisense molecule is about 12 to about 20 nucleotides in length, about 12 to about 21 nucleotides in length, about 12 to about 22 nucleotides in length, about 12 to about 23 nucleotides in length, about 12 to about 24 nucleotides in length, about 12 to about 25 nucleotides in length, about 12 to about 26 nucleotides in length, about 12 to about 27 nucleotides in length, about 12 to about 28 nucleotides in length, about 12 to about 29 nucleotides in length, or about 12 to about 30 nucleotides in length. In exemplary aspects, the antisense molecule is about 13 to about 20 nucleotides in length, about 13 to about 21 nucleotides in length, about 13 to about 22 nucleotides in length, about 13 to about 23 nucleotides in length, about 13 to about 24 nucleotides in length, about 13 to about 25 nucleotides in length, about 13 to about 26 nucleotides in length, about 13 to about 27 nucleotides in length, about 13 to about 28 nucleotides in length, about 13 to about 29 nucleotides in length, or about 13 to about 30 nucleotides in length. In exemplary aspects, the antisense molecule is about 14 to about 20 nucleotides in length, about 14 to about 21 nucleotides in length, about 14 to about 22 nucleotides in length, about 14 to about 23 nucleotides in length, about 14 to about 24 nucleotides in length, about 14 to about 25 nucleotides in length, about 14 to about 26 nucleotides in length, about 14 to about 27 nucleotides in length, about 14 to about 28 nucleotides in length, about 14 to about 29 nucleotides in length, or about 14 to about 30 nucleotides in length. In exemplary aspects, the antisense molecule is about 15 to about 20 nucleotides in length, about 15 to about 21 nucleotides in length, about 15 to about 22 nucleotides in length, about 15 to about 23 nucleotides in length, about 15 to about 24 nucleotides in length, about 15 to about 25 nucleotides in length, about 15 to about 26 nucleotides in length, about 15 to about 27 nucleotides in length, about 15 to about 28 nucleotides in length, about 15 to about 29 nucleotides in length, or about 15 to about 30 nucleotides in length. In exemplary aspects, the antisense molecule is about 15 to about 30 nucleotides in length or about 20 to 30 nucleotides in length or about 25 to 30 nucleotides in length. In exemplary aspects, the antisense molecule is about 25 nucleotides in length.

In exemplary aspects, the antisense molecule binds to at least a portion of the sequence of SEQ ID NO: 5 of the α1A mRNA. SEQ ID NO: 5 is a portion of the sequence of the nucleic acid encoding the α1ACT protein (known in the art as GenBank Accession No. NM_01127222 and provided herein as SEQ ID NO: 4. SEQ ID NO: 5 is 5101 through 6110 bp of GenBank Accession No. NM_01127222 (SEQ ID NO: 4)). In exemplary aspects, the antisense molecule binds to at least a portion of the sequence of SEQ ID NO: 5 of the α1A mRNA, wherein the portion is at least 5 contiguous nucleotides (or at least 2 or at least 3 contiguous nucleotides) of SEQ ID NO: 5. In exemplary aspects, the antisense molecule binds to at least 15 contiguous nucleotides of the sequence of SEQ ID NO: 5. In exemplary aspects, the antisense molecule binds to at least 20 contiguous nucleotides of the sequence of SEQ ID NO: 5. In exemplary aspects, the antisense molecule binds to at least 25 contiguous nucleotides of the sequence of SEQ ID NO: 5. In exemplary aspects, the antisense molecule binds to a portion of the α1A mRNA (and for purposes herein, this portion is termed hereinafter as a target sequence) and the target sequence comprises the ATG start site (i.e., start codon) of the sequence encoding α1ACT (plus flanking sequence upstream and/or downstream of the ATG start site). The coding sequence of α1ACT is provided herein as SEQ ID NO: 12 and the α1A mRNA comprising the coding sequence and the ATG start site is provided herein as SEQ ID NO: 4. In exemplary aspects, the antisense molecule binds to a target sequence of the α1A mRNA, which target sequence is located upstream or 5' to the ATG start codon of the sequence encoding α1ACT. In exemplary aspects, the antisense molecule binds to a target sequence which is located within the 200 nucleotides immediately upstream or 5' to the ATG start codon of the sequence encoding α1ACT. In exemplary aspects, the antisense molecule binds to a target sequence which is located within the 100 nucleotides immediately upstream or 5' to the ATG start codon of the sequence encoding α1ACT. In exemplary aspects, the antisense molecule binds to a target sequence which is located within the 50 nucleotides immediately upstream or 5' to the ATG start codon of the sequence encoding α1ACT. In exemplary aspects, the antisense molecule binds to a target sequence which is located within the 25 nucleotides immediately upstream or 5' to the ATG start codon of the sequence encoding α1ACT. In exemplary aspects, the antisense molecule binds to a target sequence which is located within the 15 nucleotides immediately upstream or 5' to the ATG start codon of the sequence encoding α1ACT. In exemplary aspects, the antisense molecule binds to a target sequence of the α1A mRNA, which target sequence is located downstream or 3' to the ATG start codon of the sequence encoding α1ACT. In exemplary aspects, the antisense molecule binds to a target sequence which is located within the 200 nucleotides immediately downstream or 3' to the ATG start codon of the sequence encoding α1ACT. In exemplary aspects, the antisense molecule binds to a target sequence which is located within the 100 nucleotides immediately downstream or 3' to the ATG start codon of the sequence encoding α1ACT. In exemplary aspects, the antisense molecule binds to a target sequence which is located within the 50 nucleotides immediately downstream or 3' to the ATG start codon of the sequence encoding α1ACT. In exemplary aspects, the antisense molecule binds to a target sequence which is located within the 25 nucleotides immediately downstream or 3' to the ATG start codon of the sequence encoding α1ACT. In exemplary aspects, the antisense molecule binds to a target sequence which is located within the 15 nucleotides immediately downstream or 3' to the ATG start codon of the sequence encoding α1ACT.

In exemplary aspects, the antisense molecule binds to at least a portion of the sequence of SEQ ID NO: 6 of the α1A mRNA. In exemplary aspects, the antisense molecule binds to at least a portion of the sequence of SEQ ID NO: 6 of the α1A mRNA, wherein the portion is at least 3 contiguous nucleotides (or at least 5 or at least 2 contiguous nucleotides) of SEQ ID NO: 6. In exemplary aspects, the antisense molecule binds to at least 15 contiguous nucleotides of the sequence of SEQ ID NO: 6. In exemplary aspects, the antisense molecule binds to at least 20 contiguous nucleotides of the sequence of SEQ ID NO: 6. In exemplary aspects, the antisense molecule binds to at least 25 contiguous nucleotides of the sequence of SEQ ID NO: 6. In exemplary aspects, the antisense molecule binds to at least a portion of the sequence of SEQ ID NO: 7 of the α1A mRNA. In exemplary aspects, the antisense molecule binds to at least a portion of the sequence of SEQ ID NO: 7 of the α1A mRNA, wherein the portion is at least 2 contiguous nucleotides (or at least 5 or at least 3 contiguous nucleotides) of SEQ ID NO: 7. In exemplary aspects, the antisense molecule binds to the entire sequence of SEQ ID NO: 7.

In exemplary aspects, the antisense molecule is an antisense oligonucleotide or antisense nucleic acid analog which is complementary to at least a portion of the sequence of SEQ ID NO: 5, SEQ ID NO: 6, or SEQ ID NO: 7. The antisense molecule in some aspects is complementary to at least 15 contiguous bases of said sequence. The antisense molecule in some aspects is complementary to at least 20 contiguous bases of the sequence of SEQ ID NO: 5, SEQ ID NO: 6, or SEQ ID NO: 7. The antisense molecule in some aspects is complementary to at least 25 contiguous bases of the sequence of SEQ ID NO: 5, SEQ ID NO: 6, or SEQ ID NO: 7. In exemplary aspects, the antisense molecule is an antisense oligonucleotide or antisense nucleic acid analog comprising at least 15 contiguous bases of SEQ ID NO: 9, SEQ ID NO: 10, or SEQ ID NO: 11, which are complementary sequences of SEQ ID NOs: 5-7, respectively. In exemplary aspects, the antisense molecule is an antisense oligonucleotide or antisense nucleic acid analog comprising at least 15 contiguous bases that differs by not more than 3 bases from a portion of 15 contiguous bases of SEQ ID NO: 9, SEQ ID NO: 10, or SEQ ID NO: 11. In exemplary aspects, the antisense molecule is an antisense oligonucleotide or antisense nucleic acid analog comprising at least 15 contiguous bases that is at least 90% identical to a portion of 15 contiguous bases of SEQ ID NO: 9, SEQ ID NO: 10, or SEQ ID NO: 11. In exemplary aspects, the antisense molecule is an antisense oligonucleotide or antisense nucleic acid analog comprising, consisting essentially of, or consisting of SEQ ID NO: 8.

In exemplary aspects, the antisense molecule binds to at least a portion of the sequence of SEQ ID NO: 56 of the α1A mRNA. In exemplary aspects, the antisense molecule binds to at least a portion of the sequence of SEQ ID NO: 56 of the α1A mRNA, wherein the portion is at least 2 contiguous nucleotides (or at least 5 or at least 3 contiguous nucleotides) of SEQ ID NO: 56. In exemplary aspects, the antisense molecule binds to the entire sequence of SEQ ID NO: 56. In exemplary aspects, the antisense molecule binds to at least a portion of the sequence of SEQ ID NO: 57 of the α1A mRNA. In exemplary aspects, the antisense molecule binds to at least a portion of the sequence of SEQ ID NO: 57 of the α1A mRNA, wherein the portion is at least 2 contiguous nucleotides (or at least 5 or at least 3 contiguous nucleotides) of SEQ ID NO: 57. In exemplary aspects, the antisense molecule binds to the entire sequence of SEQ ID NO: 57.

In exemplary aspects, the antisense molecule is an antisense oligonucleotide or antisense nucleic acid analog which is complementary to at least a portion of the sequence of SEQ ID NO: 56 or SEQ ID NO: 57. The antisense molecule in some aspects is complementary to at least 15 contiguous bases of said sequence. The antisense molecule in some aspects is complementary to at least 20 contiguous bases of the sequence of SEQ ID NO: 56 or SEQ ID NO: 57. The antisense molecule in some aspects is complementary to at least 25 contiguous bases of the sequence of SEQ ID NO: 56. In exemplary aspects, the antisense molecule is an antisense oligonucleotide or antisense nucleic acid analog comprising at least 15 contiguous bases of SEQ ID NO: 58 or SEQ ID NO: 59, which are complementary sequences of SEQ ID NOs: 56 and 57, respectively. In exemplary aspects, the antisense molecule is an antisense oligonucleotide or antisense nucleic acid analog comprising at least 15 contiguous bases that differs by not more than 3 bases from a portion of 15 contiguous bases of SEQ ID NO: 58 or SEQ ID NO: 59. In exemplary aspects, the antisense molecule is an antisense oligonucleotide or antisense nucleic acid analog comprising at least 15 contiguous bases that is at least 90% identical to a portion of 15 contiguous bases of SEQ ID NO: 58 or SEQ ID NO: 59. In exemplary aspects, the antisense molecule is an antisense oligonucleotide or antisense nucleic acid analog comprising, consisting essentially of, or consisting of SEQ ID NO: 55.

In exemplary aspects, the antisense molecule binds to at least a portion of the sequence of SEQ ID NO: 180. In exemplary aspects, the antisense molecule binds to at least a portion of the sequence of SEQ ID NO: 180 of the α1A mRNA, wherein the portion is at least 5 contiguous nucleotides (or at least 2 or at least 3 contiguous nucleotides) of SEQ ID NO: 180. In exemplary aspects, the antisense molecule binds to at least 15 contiguous nucleotides of the sequence of SEQ ID NO: 180. In exemplary aspects, the antisense molecule binds to at least 20 contiguous nucleotides of the sequence of SEQ ID NO: 180. In exemplary aspects, the antisense molecule binds to at least 25 contiguous nucleotides of the sequence of SEQ ID NO: 180.

In exemplary aspects, the antisense molecule is an antisense oligonucleotide or antisense nucleic acid analog which is complementary to at least a portion of the sequence of SEQ ID NO: 180. The antisense molecule in some aspects is complementary to at least 15 contiguous bases of said sequence. The antisense molecule in some aspects is complementary to at least 20 contiguous bases of the sequence of SEQ ID NO: 180. The antisense molecule in some aspects is complementary to at least 25 contiguous bases of the sequence of SEQ ID NO: 180. In exemplary aspects, the antisense molecule is an antisense oligonucleotide or antisense nucleic acid analog comprising at least 15 contiguous bases of SEQ ID NO: 179. In exemplary aspects, the antisense molecule is an antisense oligonucleotide or antisense nucleic acid analog comprising at least 15 contiguous bases that differs by not more than 3 bases from a portion of 15 contiguous bases of SEQ ID NO: 179. In exemplary aspects, the antisense molecule is an antisense oligonucleotide or antisense nucleic acid analog comprising at least 15 contiguous bases that is at least 90% identical to a portion of 15 contiguous bases of SEQ ID NO: 179. In exemplary aspects, the antisense molecule is an antisense oligonucleotide or antisense nucleic acid analog comprising, consisting essentially of, or consisting of SEQ ID NO: 179.

The antisense molecule can be one which mediates RNA interference (RNAi). As known by one of ordinary skill in the art, RNAi is a ubiquitous mechanism of gene regulation in plants and animals in which target mRNAs are degraded in a sequence-specific manner (Sharp, Genes Dev., 15, 485-490 (2001); Hutvagner et al., Curr. Opin. Genet. Dev., 12, 225-232 (2002); Fire et al., Nature, 391, 806-811 (1998); Zamore et al., Cell, 101, 25-33 (2000)). The natural RNA degradation process is initiated by the dsRNA-specific endonuclease Dicer, which promotes cleavage of long dsRNA precursors into double-stranded fragments between 21 and 25 nucleotides long, termed small interfering RNA (siRNA; also known as short interfering RNA) (Zamore, et al., Cell. 101, 25-33 (2000); Elbashir et al., Genes Dev., 15, 188-200 (2001); Hammond et al., Nature, 404, 293-296 (2000); Bernstein et al., Nature, 409, 363-366 (2001)). siRNAs are incorporated into a large protein complex that recognizes and cleaves target mRNAs (Nykanen et al., Cell, 107, 309-321 (2001). It has been reported that introduction of dsRNA into mammalian cells does not result in efficient Dicer-mediated generation of siRNA and therefore does not induce RNAi (Caplen et al., Gene 252, 95-105 (2000); Ui-Tei et al., FEBS Lett, 479, 79-82 (2000)). The requirement for Dicer in maturation of siRNAs in cells can be bypassed by introducing synthetic 21-nucleotide siRNA duplexes, which inhibit expression of transfected and endogenous genes in a variety of mammalian cells (Elbashir et al., Nature, 411: 494-498 (2001)).

In this regard, the IRES inhibitor in some aspects mediates RNAi and in some aspects is a siRNA molecule specific for inhibiting the expression of the nucleic acid (e.g., the mRNA) encoding the α1ACT protein. The term "siRNA" as used herein refers to an RNA (or RNA analog) comprising from about 10 to about 50 nucleotides (or nucleotide analogs) which is capable of directing or mediating RNAi. In exemplary embodiments, an siRNA molecule comprises about 15 to about 30 nucleotides (or nucleotide analogs) or about 20 to about 25 nucleotides (or nucleotide analogs), e.g., 21-23 nucleotides (or nucleotide analogs). The siRNA can be double or single stranded, preferably double-stranded.

In alternative aspects, the IRES inhibitor is alternatively a short hairpin RNA (shRNA) molecule specific for inhibiting the expression of the nucleic acid (e.g., the mRNA) encoding the α1ACT protein. The term "shRNA" as used herein refers to a molecule of about 20 or more base pairs in which a single-standed RNA partially contains a palindromic base sequence and forms a double-strand structure therein (i.e., a hairpin structure). An shRNA can be an siRNA (or siRNA analog) which is folded into a hairpin structure. shRNAs typically comprise about 45 to about 60 nucleotides, including the approximately 21 nucleotide antisense and sense portions of the hairpin, optional overhangs on the non-loop side of about 2 to about 6 nucleotides long, and the loop portion that can be, e.g., about 3 to 10 nucleotides long. The shRNA can be chemically synthesized. Alternatively, the shRNA can be produced by linking sense and antisense strands of a DNA sequence in reverse directions and synthesizing RNA in vitro with T7 RNA polymerase using the DNA as a template.

Though not wishing to be bound by any theory or mechanism it is believed that after shRNA is introduced into a cell, the shRNA is degraded into a length of about 20 bases or more (e.g., representatively 21, 22, 23 bases), and causes RNAi, leading to an inhibitory effect. Thus, shRNA elicits RNAi and therefore can be used as an effective component of the invention. shRNA may preferably have a 3'-protruding end. The length of the double-stranded portion is not particularly limited, but is preferably about 10 or more nucleotides, and more preferably about 20 or more nucleotides. Here, the 3'-protruding end may be preferably DNA, more preferably DNA of at least 2 nucleotides in length, and even more preferably DNA of 2-4 nucleotides in length.

In exemplary aspects, the antisense molecule is a microRNA (miRNA). As used herein the term "microRNA" refers to a small (e.g., 15-22 nucleotides), non-coding RNA molecule which base pairs with mRNA molecules to silence gene expression via translational repression or target degradation. microRNA and the therapeutic potential thereof are described in the art. See, e.g., Mulligan, *MicroRNA: Expression, Detection, and Therapeutic Strategies*, Nova Science Publishers, Inc., Hauppauge, N.Y., 2011; Bader and Lammers, "The Therapeutic Potential of microRNAs" *Innovations in Pharmaceutical Technology*, pages 52-55 (March 2011); and Zhang et al., *J Control Release* 172(3): 962-974 (2013). In exemplary aspects, the miRNA is a mature miRNA strand.

In exemplary aspects, the miRNA targets a portion of the IRES of the CACNA1A gene wherein the portion comprises sequence of SEQ ID NO: 180. As understood by the ordinarily skilled artisan, miRNA does not require perfect pairing to its target. Thus, in exemplary aspects, the miRNA binds to at least a portion of the sequence of SEQ ID NO: 180. In exemplary aspects, the miRNA is complementary to at least a portion of the sequence of SEQ ID NO: 180. The miRNA in some aspects is complementary to at least 15 contiguous bases of said sequence. In exemplary aspects, the miRNA comprises at least 15 contiguous bases of SEQ ID NO: 179. In exemplary aspects, the miRNA comprises at least 15 contiguous bases that differ by not more than 3 bases from a portion of 15 contiguous bases of SEQ ID NO: 179. In exemplary aspects, the miRNA comprises at least 15 contiguous bases that is at least 90% identical to a portion of 15 contiguous bases of SEQ ID NO: 179. In exemplary aspects, the miRNA comprises, consists essentially of, or consists of SEQ ID NO: 179. In exemplary aspects, the miRNA is about 15, about 16, about 17, about 18, about 19, about 20, about 21, about 22, about 23, about 24 nt in length.

In exemplary aspects, the antisense molecule is a precursor of miRNA comprising SEQ ID NO: 179. In exemplary aspects, the antisense molecule is a primary miRNA precursor (pri-miRNA) comprising SEQ ID NO: 179 which is optionally, capped, polyadenylated, and/or comprises double-stranded stem-loop structures. In exemplary aspects, the antisense molecule is a pre-miRNA precursor comprising SEQ ID NO: 179, which is optionally about 70 to about 100 nt long and/or comprises a hairpin structure.

In exemplary aspects, the miRNA comprises the sequence of SEQ ID NO: 179. In exemplary aspects, the miRNA comprises at least 15 contiguous bases of a sequence that (i) differs from SEQ ID NO: 179 by not more than 3 bases (e.g., not more than 4, 5, 6, 7, 8, 9, 10 bases), (ii) is at least 90% (e.g., at least 93%, at least 95%, at least 98%, at least 99%) identical to the sequence set forth in SEQ ID NO: 179, or (iii) is completely complementary to at least a portion of the sequence of SEQ ID NO: 180.

In exemplary aspects, the antisense molecule is an antisense oligonucleotide comprising DNA or RNA or both DNA and RNA. In exemplary aspects, the antisense oligonucleotide comprises naturally-occurring nucleotides and/or naturally-occurring internucleotide linkages. The antisense oligonucleotide in some aspects is single-stranded and in other aspects is double-stranded. In exemplary aspects, the antisense oligonucleotide is synthesized and in other aspects is obtained (e.g., isolated and/or purified) from natural sources. In exemplary aspects, the antisense molecule is a phosphodiester oligonucleotide.

In alternative aspects, the antisense molecule is an antisense nucleic acid analog, e.g., comprising non-naturally-occurring nucleotides and/or non-naturally-occurring internucleotide linkages (e.g., phosphoroamidate linkages, phosphorothioate linkages). In exemplary aspects, the antisense nucleic acid analog comprises at least one non-naturally-occurring nucleotide and/or non-naturally-occurring internucleotide linkage. In exemplary aspects, the antisense nucleic acid analog comprises one or more modified nucleotides, including, but not limited to, 5-fluorouracil, 5-bromouracil, 5-chlorouracil, 5-iodouracil, hypoxanthine, xanthine, 4-acetylcytosine, 5-(carboxyhydroxymethyl) uracil, 5-carboxymethyl aminomethyl-2-thiouridine, 5-carboxymethylaminomethyluracil, dihydrouracil, beta-D-galactosylqueuosine, inosine, $N^6$-isopentenyladenine, 1-methylguanine, 1-methylinosine, 2,2-dimethylguanine, 2-methyladenine, 2-methylguanine, 3-methyl cytosine, 5-methyl cytosine, N-substituted adenine, 7-methylguanine, 5-methylammomethyluracil, 5-methoxyaminomethyl-2-thiouracil, beta-D-mannosylqueuosine, 5'-methoxycarboxymethyluracil, 5-methoxyuracil, 2-methylthio-$N^6$-isopentenyladenine, uracil-5-oxyacetic acid (v), wybutoxosine, pseudouracil, queuosine, 2-thiocytosine, 5-methyl-2-thiouracil, 2-thiouracil, 4-thiouracil, 5-methyluracil, uracil-5-oxyacetic acid methylester, 3-(3-amino-3-N-2-carboxypropyl) uracil, and 2,6-diaminopurine.

In exemplary aspects, the antisense nucleic acid comprises non-naturally-occurring nucleotides which differ from naturally occurring nucleotides by comprising a chemical group in place of the phosphate group. In exemplary aspects, the antisense nucleic acid analog comprises or is a methylphosphonate oligonucleotide, which are noncharged oligomers in which a non-bridging oxygen atom, e.g., alpha oxygen of the phosphate, is replaced by a methyl group. In exemplary aspects, the antisense nucleic acid analog comprises or is a phosphorothioate, wherein at least one of the non-bridging oxygen atom, e.g., alpha oxygen of the phosphate, is replaced by a sulfur. In exemplary aspects, the antisense nucleic acid analog comprises or is a boranophosphate olignucleotide, wherein at least one of the non-bridging oxygen atom, e.g., alpha oxygen of the phosphate, is replaced by $—BH_3$.

In exemplary aspects, the antisense nucleic acid analog comprises at least one non-naturally-occurring nucleotide which differs from naturally occurring nucleotides by comprising a ring structure other than ribose or 2-deoxyribose. In exemplary aspects, the antisense nucleic acid analog is an analog comprising a replacement of the hydroxyl at the 2'-position of ribose with an O-alkyl group, e.g., $—O—CH_3$, $—OCH_2CH_3$. In exemplary aspects, the antisense nucleic acid analog comprises a modified ribonucleotide wherein the 2' hydroxyl of ribose is modified to methoxy (OMe) or methoxy-ethyl (MOE) group. In exemplary aspects, the antisense nucleic acid analog comprises a modified ribonucleotide wherein the 2' hydroxyl of ribose is replaced with allyl, amino, azido, halo, thio, O-allyl, $O—C_1-C_{10}$ alkyl, $O—C_1-C_{10}$ substituted alkyl, $O—C_1-C_{10}$ alkoxy, $O—C_1-C_{10}$ substituted alkoxy, $OCF_3$, $O(CH_2)_2SCH_3$, $O(CH_2)_2—O—N(R^1)(R^2)$, or $O(CH_2)—C(=O)—N(R^1)(R^2)$, wherein each of $R^1$ and $R^2$ is independently selected from the group consisting of H, an amino protecting group or substituted or unsubstituted $C_1-C_{10}$ alkyl. In exemplary aspects, the antisense nucleic acid analog comprises a modified ribonucleotide wherein the 2' hydroxyl of ribose is replaced with 2'F, SH, CN, OCN, $CF_3$, O-alkyl, S-Alkyl, $N(R^1)$alkyl, O-alkenyl, S-alkenyl, or $N(R^1)$-alkenyl, O-alkynyl, S-alkynyl, $N(R^1)$-alkynyl, O-alkylenyl, O-Alkyl, alknyyl, alkaryl, aralkyl, O-alkaryl, or O-aralkyl. In exemplary aspects, the antisense nucleic acid analog is an analog comprising a replacement of the hydrogen at the 2'-position of ribose with halo, e.g., F. In exemplary aspects, the antisense nucleic acid analog comprises a fluorine derivative nucleic acid.

In exemplary aspects, the antisense nucleic acid analog comprises a substituted ring. In exemplary aspects, the antisense nucleic acid analog is or comprises a hexitol nucleic acid. In exemplary aspects, the antisense nucleic acid analog is or comprises a nucleotide with a bicyclic or tricyclic sugar moiety. In exemplary aspects, the bicyclic sugar moiety comprises a bridge between the 4' and 2' furanose ring atoms. Examplary moieties include, but are not limited to: —[C($R_a$)($R_b$)]$_n$—, —[C($R_a$)($R_b$)]$_n$-0-, —C($R_aR_b$)—N(R)-0- or, —C($R_aR_b$)-0-N(R)—; 4'-CH$_2$-2', 4'-(CH$_2$)$_2$-2', 4'-(CH$_2$)$_3$-2', 4'-(CH$_2$)-0-2' (LNA); 4'-(CH$_2$)—S-2'; 4'-(CH$_2$)$_2$-0-2' (ENA); 4'-CH(CH$_3$)-0-2' (cEt) and 4'-CH(CH$_2$OCH$_3$)-0-2', 4'-C(CH$_3$)(CH$_3$)-0-2', 4'-CH$_2$—N(OCH$_3$)-2', 4'-CH$_2$-0-N(CH$_3$)-2' 4'-CH$_2$-0-N(R)-2', and 4'-CH$_2$—N(R)-0-2'-, wherein each R is, independently, H, a protecting group, or $C_1C_{12}$ alkyl; 4'-CH$_2$—N(R)-0-2', wherein R is H, C1-C12 alkyl, or a protecting group, 4'-CH$_2$—C(H)(CH$_3$)-2', 4'-CH$_2$—C(=CH$_2$)-2'. Such antisense nucleic acid analogs are known in the art. See, e.g., International Application Publication No. WO 2008/154401, U.S. Pat. No. 7,399,845, International Application Publication No. WO2009/006478, International Application Publication No. WO2008/150729, U.S. Application Publication No. US2004/0171570, U.S. Pat. No. 7,427,672, and Chattopadhyaya, et al, J. Org. Chem.,2009, 74, 118-134). In exemplary aspects, the antisense nucleic acid analog comprises a nucleoside comprising a bicyclic sugar moiety, or a bicyclic nucleoside (BNA). In exemplary aspects, the antisense nucleic acid analog comprises a BNA selected from the group consisting of: α-L-Methyleneoxy (4'-CH$_2$-0-2') BNA, Aminooxy (4'-CH$_2$-0-N(R)-2') BNA, β-D-Methyleneoxy (4'-CH$_2$-0-2') BNA, Ethyleneoxy (4'-(CH$_2$)$_2$-0-2') BNA, methylene-amino (4'-CH2-N(R)-2') BNA, methyl carbocyclic (4'-CH$_2$—CH(CH$_3$)-2') BNA, Methyl(methyleneoxy) (4'-CH(CH$_3$)-0-2') BNA (also known as constrained ethyl or cEt), methylene-thio (4'-CH$_2$—S-2') BNA, Oxyamino (4'-CH$_2$—N(R)-0-2') BNA, and propylene carbocyclic (4'-(CH$_2$)$_3$-2') BNA. Such BNAs are described in the art. See, e.g., International Patent Publication No. WO 2014/071078.

In exemplary aspects, the antisense nucleic acid analog comprises a modified backbone. In exemplary aspects, the antisense nucleic acid analog is or comprises a peptide nucleic acid (PNA) containing an uncharged flexible polyamide backbone comprising repeating N-(2-aminoethyl)glycine units to which the nucleobases are attached via methylene carbonyl linkers. In exemplary aspects, the antisense nucleic acid analog comprises a backbone substitution. In exemplary aspects, the antisense nucleic acid analog is or comprises an N3'→P5' phosphoramidate, which results from the replacement of the oxygen at the 3' position on ribose by an amine group. Such nucleic acid analogs are further described in Dias and Stein, *Molec Cancer Ther* 1: 347-355 (2002). In exemplary aspects, the antisense nucleic acid analog comprises a nucleotide comprising a conformational lock. In exemplary aspects, the antisense nucleic acid analog is or comprises a locked nucleic acid.

In exemplary aspects, the antisense nucleic acid analog comprises a 6-membered morpholine ring, in place of the ribose or 2-deoxyribose ring found in RNA or DNA. In exemplary aspects, the antisense nucleic acid analog comprises non-ionic phophorodiamidate intersubunit linkages in place of anionic phophodiester linkages found in RNA and DNA. In exemplary aspects, the nucleic acid analog comprises nucleobases (e.g., adenine (A), cytosine (C), guanine (G), thymine, thymine (T), uracil (U)) found in RNA and DNA. In exemplary aspects, the IRES inhibitor is a Morpholino oligomer comprising a polymer of subunits, each subunit of which comprises a 6-membered morpholine ring and a nucleobase (e.g., A, C, G, T, U), wherein the units are linked via non-ionic phophorodiamidate intersubunit linkages. For purposes herein, when referring to the sequence of a Morpholino oligomer, the conventional single-letter nucleobase codes (e.g., A, C, G, T, U) are used to refer to the nucleobase attached to the morpholine ring.

In exemplary aspects, the Morpholino oligomer binds to at least a portion of the sequence of SEQ ID NO: 5 of the α1A mRNA. In exemplary aspects, the Morpholino oligomer binds to at least a portion of the sequence of SEQ ID NO: 6 of the α1A mRNA. In exemplary aspects, the Morpholino oligomer binds to at least a portion of the sequence of SEQ ID NO: 7 of the α1A mRNA. In exemplary aspects, the Morpholino oligomer is complementary to at least a portion of the sequence of SEQ ID NO: 5, SEQ ID NO: 6, or SEQ ID NO: 7. The Morpholino oligomer in some aspects is complementary to at least 15 contiguous bases of said sequence. In exemplary aspects, the Morpholino oligomer comprises at least 15 contiguous bases of SEQ ID NO: 9, SEQ ID NO: 10, or SEQ ID NO: 11. In exemplary aspects, the Morpholino oligomer comprises at least 15 contiguous bases that differ by not more than 3 bases from a portion of 15 contiguous bases of SEQ ID NO: 9, SEQ ID NO: 10, or SEQ ID NO: 11. In exemplary aspects, the Morpholino oligomer comprises at least 15 contiguous bases that is at least 90% identical to a portion of 15 contiguous bases of SEQ ID NO: 9, SEQ ID NO: 10, or SEQ ID NO: 11. In exemplary aspects, the Morpholino oligomer comprises, consists essentially of, or consists of SEQ ID NO: 8.

In exemplary aspects, the Morpholino oligomer comprises the sequence of SEQ ID NO: 8. In exemplary aspects, the Morpholino oligomer comprises at least 15 contiguous bases of a sequence that (i) differs from SEQ ID NO: 8 by not more than 3 bases (e.g., not more than 4, 5, 6, 7, 8, 9, 10 bases), (ii) is at least 90% (e.g., at least 93%, at least 95%, at least 98%, at least 99%) identical to the sequence set forth in SEQ ID NO: 8, or (iii) is completely complementary to at least a portion of the sequence of SEQ ID NO: 6 or 7.

In exemplary aspects, the Morpholino oligomer binds to at least a portion of the sequence of SEQ ID NO: 56 of the α1A mRNA. In exemplary aspects, the Morpholino oligomer binds to at least a portion of the sequence of SEQ ID NO: 57 of the α1A mRNA. In exemplary aspects, the Morpholino oligomer is complementary to at least a portion of the sequence of SEQ ID NO: 56 or SEQ ID NO: 57. The Morpholino oligomer in some aspects is complementary to at least 15 contiguous bases of said sequence. In exemplary aspects, the Morpholino oligomer comprises at least 15 contiguous bases of SEQ ID NO: 58 or SEQ ID NO: 59. In exemplary aspects, the Morpholino oligomer comprises at least 15 contiguous bases that differ by not more than 3 bases from a portion of 15 contiguous bases of SEQ ID NO: 58 or SEQ ID NO: 59. In exemplary aspects, the Morpholino oligomer comprises at least 15 contiguous bases that is at least 90% identical to a portion of 15 contiguous bases of SEQ ID NO: 58 or SEQ ID NO: 59. In exemplary aspects, the Morpholino oligomer comprises, consists essentially of, or consists of SEQ ID NO: 55.

In exemplary aspects, the Morpholino oligomer comprises the sequence of SEQ ID NO: 55. In exemplary aspects, the Morpholino oligomer comprises at least 15 contiguous bases of a sequence that (i) differs from SEQ ID NO: 55 by not more than 3 bases (e.g., not more than 4, 5, 6, 7, 8, 9, 10 bases), (ii) is at least 90% (e.g., at least 93%, at least 95%, at least 98%, at least 99%) identical to the sequence set forth in SEQ ID NO: 55, or (iii) is completely complementary to at least a portion of the sequence of SEQ ID NO: 56 or 57.

Subjects

As used herein, the term "subject" is meant any living organism. In exemplary aspects, the subject is a mammal. The term "mammal" as used herein refers to any mammal, including, but not limited to, mammals of the order Rodentia, such as mice and hamsters, and mammals of the order Logomorpha, such as rabbits. It is preferred that the mammals are from the order Carnivora, including Felines (cats) and Canines (dogs). It is further preferred that the mammals are from the order Artiodactyla, including Bovines (cows) and Swines (pigs) or of the order Perssodactyla, including Equines (horses). It is further preferred that the mammals are of the order Primates, Ceboids, or Simoids (monkeys) or of the order Anthropoids (humans and apes). In exemplary aspect, the subject is a human.

In exemplary embodiments, the human has, is diagnosed with, and/or suffers from a genetic disease, including, any of those known in the art and/or described herein. In exemplary aspects, the subject has, is diagnosed with, and/or suffers from a trinucleotide repeat disorder, such as a polyglutamine disease. In exemplary aspects, the human has, is diagnosed with, and/or suffers from SCA6.

Vectors

In exemplary aspects, the IRES inhibitor is a recombinant expression vector encoding an antisense molecule described herein. Accordingly, the invention provides a recombinant expression vector comprising a nucleotide sequence encoding an antisense molecule described herein. For purposes herein, the term "recombinant expression vector" means a genetically-modified oligonucleotide or polynucleotide construct that permits the expression of a nucleic acid by a host cell, when the construct comprises a nucleotide sequence encoding the nucleic acid, and the vector is contacted with the cell under conditions sufficient to have the nucleic acid expressed within the cell. The recombinant expression vectors of the invention are not naturally-occurring as a whole. However, parts of the vectors may be naturally-occurring. The inventive recombinant expression vectors may comprise any type of nucleotides, including, but not limited to DNA and RNA, which may be single-stranded or double-stranded, synthesized or obtained in part from natural sources, and which may contain natural, non-natural or altered nucleotides. The recombinant expression vectors may comprise naturally-occurring or non-naturally-occuring internucleotide linkages, or both types of linkages. In exemplary aspects, the altered nucleotides or non-naturally occurring internucleotide linkages do not hinder the transcription or replication of the vector.

In exemplary aspects, the recombinant expression vector encodes an antisense molecule which binds to SEQ ID NO: 180. In exemplary aspects, the recombinant expression vector encodes an antisense molecule which binds to at least a portion of the sequence of SEQ ID NO: 180 of the α1A mRNA, wherein the portion is at least 5 contiguous nucleotides (or at least 2 or at least 3 contiguous nucleotides) of SEQ ID NO: 180. In exemplary aspects, the recombinant expression vector encodes an antisense molecule which binds to at least 15 contiguous nucleotides of the sequence of SEQ ID NO: 180. In exemplary aspects, the recombinant expression vector encodes an antisense molecule which binds to at least 20 contiguous nucleotides of the sequence of SEQ ID NO: 180. In exemplary aspects, the recombinant expression vector encodes an antisense molecule binds to at least 25 contiguous nucleotides of the sequence of SEQ ID NO: 180.

In exemplary aspects, the recombinant expression vector encodes an antisense molecule which is complementary to at least a portion of the sequence of SEQ ID NO: 180. In exemplary aspects, the recombinant expression vector encodes an antisense molecule which is complementary to at least 15 contiguous bases of said sequence of SEQ ID NO: 180. In exemplary aspects, the recombinant expression vector encodes an antisense molecule which is complementary to at least 20 contiguous bases of the sequence of SEQ ID NO: 180. In exemplary aspects, the recombinant expression vector encodes an antisense molecule which is complementary to at least 25 contiguous bases of the sequence of SEQ ID NO: 180. In exemplary aspects, the recombinant expression vector encodes an antisense oligonucleotide comprising at least 15 contiguous bases of SEQ ID NO: 179. In exemplary aspects, the recombinant expression vector encodes an antisense oligonucleotide comprising at least 15 contiguous bases that differs by not more than 3 bases from a portion of 15 contiguous bases of SEQ ID NO: 179. In exemplary aspects, the recombinant expression vector encodes an antisense oligonucleotide comprising at least 15 contiguous bases that is at least 90% identical to a portion of 15 contiguous bases of SEQ ID NO: 179. In exemplary aspects, the recombinant expression vector encodes an antisense oligonucleotide comprising, consisting essentially of, or consisting of SEQ ID NO: 179.

In exemplary aspects, the recombinant expression vector encodes an miRNA which targets a portion of the IRES of the CACNA1A gene wherein the portion comprises sequence of SEQ ID NO: 180. As understood by the ordinarily skilled artisan, miRNA does not require perfect pairing to its target. In exemplary aspects, the recombinant expression vector encodes an miRNA which binds to at least a portion of the sequence of SEQ ID NO: 180. In exemplary aspects, the recombinant expression vector encodes an miRNA which is complementary to at least a portion of the sequence of SEQ ID NO: 180. The recombinant expression vector encodes an miRNA which in some aspects is complementary to at least 15 contiguous bases of said sequence. In exemplary aspects, the recombinant expression vector encodes an miRNA which comprises at least 15 contiguous bases of SEQ ID NO: 179. In exemplary aspects, the recombinant expression vector encodes an miRNA which comprises at least 15 contiguous bases that differ by not more than 3 bases from a portion of 15 contiguous bases of SEQ ID NO: 179. In exemplary aspects, the recombinant expression vector encodes an miRNA which comprises at least 15 contiguous bases that is at least 90% identical to a portion of 15 contiguous bases of SEQ ID NO: 179. In exemplary aspects, the recombinant expression vector encodes an miRNA which comprises, consists essentially of, or consists of SEQ ID NO: 179. In exemplary aspects, the recombinant expression vector encodes an miRNA is about 15, about 16, about 17, about 18, about 19, about 20, about 21, about 22, about 23, about 24 nt in length.

In exemplary aspects, the recombinant expression vector encodes an miRNA comprising the sequence of SEQ ID NO: 179. In exemplary aspects, the recombinant expression vector encodes an miRNA comprising at least 15 contiguous bases of a sequence that (i) differs from SEQ ID NO: 179 by not more than 3 bases (e.g., not more than 4, 5, 6, 7, 8, 9, 10 bases), (ii) is at least 90% (e.g., at least 93%, at least 95%, at least 98%, at least 99%) identical to the sequence set forth in SEQ ID NO: 179, or (iii) is completely complementary to at least a portion of the sequence of SEQ ID NO: 180.

In exemplary aspects, the recombinant expression vector encodes an antisense molecule which is a precursor of miRNA comprising SEQ ID NO: 179. In exemplary aspects, the recombinant expression vector encodes an antisense molecule which is a primary miRNA precursor (pri-miRNA) comprising SEQ ID NO: 179 which is optionally, capped, polyadenylated, and/or comprises double-stranded stem-loop structures. In exemplary aspects, the recombinant expression vector encodes an antisense molecule which is a pre-miRNA precursor comprising SEQ ID NO: 179, which is optionally about 70 to about 100 nt long and/or comprises a hairpin structure.

In exemplary aspects, the recombinant expression vector comprises a nucleotide sequence of SEQ ID NO: 181. In exemplary aspects, the recombinant expression vector comprises a nucleotide sequence which comprises at least 15 contiguous bases of SEQ ID NO: 181. For example, the recombinant expression vector comprises a nucleotide sequence which comprises at least or about 16 contiguous bases of SEQ ID NO: 181, at least or about 17 contiguous bases of SEQ ID NO: 181, at least or about 18 contiguous bases of SEQ ID NO: 181, at least or about 19 contiguous bases of SEQ ID NO: 181, at least or about 20 contiguous bases of SEQ ID NO: 181, at least or about 21 contiguous bases of SEQ ID NO: 181, at least or about 22 contiguous bases of SEQ ID NO: 181, at least or about 23 contiguous bases of SEQ ID NO: 181, at least or about 24 contiguous bases of SEQ ID NO: 181, at least or about 25 contiguous bases of SEQ ID NO: 181, at least or about 26 contiguous bases of SEQ ID NO: 181, at least or about 27 contiguous bases of SEQ ID NO: 181, or at least or about 28 contiguous bases of SEQ ID NO: 181. In exemplary aspects, the recombinant expression vector comprises a nucleotide sequence that differs from SEQ ID NO: 181 by not more than 3 bases (e.g., not more than 4, 5, 6, 7, 8, 9, 10 bases). In exemplary aspects, the recombinant expression vector comprises a nucleotide sequence which is at least 90% (e.g., at least 93%, at least 95%, at least 98%, at least 99%) identical to the sequence of SEQ ID NO: 181.

The recombinant expression vector of the invention may be any suitable recombinant expression vector, and may be used to transform or transfect any suitable host or host cell. Suitable vectors include those designed for propagation and expansion or for expression or both, such as plasmids and viruses. The vector may be selected from the group consisting of the pUC series (Fermentas Life Sciences), the pBluescript series (Stratagene, LaJolla, Calif.), the pET series (Novagen, Madison, Wis.), the pGEX series (Pharmacia Biotech, Uppsala, Sweden), and the pEX series (Clontech, Palo Alto, Calif.). Bacteriophage vectors, such as λGTIO, λGT1 1, λZapII (Stratagene), λEMBL4, and λNMI 149, also may be used. Examples of plant expression vectors include pBIO1, pBI101.2, pBI101.3, pBI121 and pBIN19 (Clontech). Examples of animal expression vectors include pEUK-Cl, pMAM and pMAMneo (Clontech).

In exemplary aspects, the recombinant expression vector is a viral vector, e.g., a retroviral vector. In exemplary aspects, the recombinant expression vector is a cytoplasmic RNA viral vector. In exemplary aspects, the recombinant expression vector is k-borne encephalitis viral vector or a Sindbis viral vector. In exemplary aspects, the recombinant expression vector is an influenza A viral vector, an adenoviral vector, an adeno-associated vector (AAV), a lentiviral vector, an arboviral vector, an Epstein Barr viral vector, a flavivirus tick-borne encephalitis viral vector, a bovine leukemia viral vector, an human immunodeficiency viral vector, a simian immunodeficiency viral vector, a vesicular stomatitis viral vector, herpes simplex viral vector, pox viral vector, parvoviral vector, vaccinia viral vector, a gammaretroviral vector, or an alphaviral vector. In exemplary aspects, the AAV is a ssAAV8, scAAV8, ssAAV9, scAAV7, scAAV9, ssAAV2, ssAAV6, ssAAV1, ssAAV1/2, ssAAV5. In exemplary aspects, the arboviral vector is a flaviviral vector, togaviral vector, bunyaviral vector, rhabdoviral vector, or a reoviral vector. Such vectors are known in the art. See, e.g., Peng et al., *Adv Drug Deliv Rev* 88: 108-122 (2015); Borel et al., *Mol Ther* 22(4): 692-701 (2014); Usme-Ciro et al., *Virol J* 10: 185 (2013); Khatri et al., *Crit Rev Ther Drug Carrier Syst* 29(6): 487-527 (2012); Liu et al., *Biochim Biophs Acta* 1809(11-12): 732-745 (2011); Kay et al., *Nature* 7(1): 33-40 (2001); and Asgari, *Viruses* 6(9): 3514-3514 (2014).

In exemplary aspects, the recombinant expression vector comprises at least one element from a viral vector. In exemplary aspects, the recombinant expression vector comprises a combination of elements from different viral vectors.

In exemplary aspects, the recombinant expression vector is a non-viral synthetic vector, including any of those described in Wang et al., *Adv Drug Deliv Rev* 81: 142-160 (2015).

The recombinant expression vectors of the invention may be prepared using standard recombinant DNA techniques described in, for example, Sambrook et al., supra, and Ausubel et al., supra. Constructs of expression vectors, which are circular or linear, may be prepared to contain a replication system functional in a prokaryotic or eukaryotic host cell. Replication systems may be derived, e.g., from CoIEl, 2µ plasmid, λ, SV40, bovine papilloma virus, and the like.

In exemplary aspects, the recombinant expression vector comprises regulatory sequences, such as transcription and translation initiation and termination codons, which are specific to the type of host (e.g., bacterium, fungus, plant, or animal) into which the vector is to be introduced, as appropriate and taking into consideration whether the vector is DNA- or RNA-based.

The recombinant expression vector may include one or more markers or marker genes, which allow for selection of transformed or transfected hosts. Marker genes include biocide resistance, e.g., resistance to antibiotics, heavy metals, etc., complementation in an auxotrophic host to provide prototrophy, and the like. Suitable markers and marker genes for the inventive expression vectors include, for instance, His-tags, FLAG tags, green fluorescence protein genes, red fluorescence protein genes, neomycin/G418 resistance genes, hygromycin resistance genes, histidinol resistance genes, tetracycline resistance genes, and ampicillin resistance genes. In exemplary aspects, the recombinant expression vector comprises a nucleotide sequence encoding green fluorescent protein (GFP) or another fluorescent protein (e.g., red fluorescent protein (RFP), cyan fluorescent protein (CFP), yellow fluorescent protein, orange fluorescent protein, far red fluorescent protein, and the like).

The recombinant expression vector may comprise a native or non-native promoter operably linked to the nucleotide sequence encoding the antisense molecule. The selection of promoters, e.g., strong, weak, inducible, tissue-specific and developmental-specific, is within the ordinary skill of the artisan. In exemplary aspects, the recombinant expression vector comprises a non-native promoter. In exemplary aspects, the recombinant expression vector comprises a promoter which is not found upstream or near the antisense molecule in its natural environment. In exemplary aspects, the recombinant expression vector comprises a non-human promoter. The promoter in exemplary aspects is a non-viral promoter or a viral promoter, e.g., a cytomegalovirus (CMV) promoter, an SV40 promoter, an RSV promoter, and a promoter found in the long-terminal repeat of the murine stem cell virus.

In exemplary aspects, the vector is a recombinant adeno-associated viral (AAV) vector encoding an antisense molecule comprising an nucleotide sequence (e.g., an antisense molecule) which binds to a portion of an IRES of a CACNA1A gene comprising the sequence of SEQ ID NO: 180 the sequence of SEQ ID NO: 179. In exemplary aspects, the AAV vector is an AAV serotype 9 (AAV9) vector. In exemplary aspects, the recombinant AAV vector comprises one or more of a promoter, a pair of inverted terminal repeats (ITRs), and a polyadenylation signal sequence. In exemplary aspects, the promoter is a human cytomegalovirus (CMV) immediate early promoter. In exemplary aspects, the ITRs are AAV ITRs. In exemplary aspects, the polyadenylation signal sequence is an simian virus 40 (SV40) polyadenylation signal sequence. In exemplary aspects, the recombinant expression vector comprises a woodchuck hepatitis virus posttranscriptional regulatory element (WPRE). In exemplary aspects, the recombinant expression vector comprises an ITR upstream of the human CMV immediate early promoter, which is located upstream of the nucleotide sequence encoding the antisense molecule, which is located upstream of the WPRE which is located upstream of the SV40 polyadenylation signal sequence which is located upstream of the the other ITR.

The inventive recombinant expression vectors may be designed for either transient expression, for stable expression, or for both. Also, the recombinant expression vectors may be made for constitutive expression or for inducible expression. Further, the recombinant expression vectors may be made to include a suicide gene. In exemplary aspects, the inventive recombinant expression vectors are designed for targeted expression. In exemplary aspects, the recombinant expression vector comprises one or more elements which cause the antisense molecule to be expressed by a specific cell population.

As used herein, the term "suicide gene" refers to a gene that causes the cell expressing the suicide gene to die. The suicide gene may be a gene that confers sensitivity to an agent, e.g., a drug, upon the cell in which the gene is expressed, and causes the cell to die when the cell is contacted with or exposed to the agent. Suicide genes are known in the art (see, for example, Suicide Gene Therapy: Methods and Reviews. Springer, Caroline J. (Maycer Research UK Centre for Maycer Therapeutics at the Institute of Maycer Research, Sutton, Surrey, UK), Humana Press, 2004) and include, for example, the Herpes Simplex Virus (HSV) thymidine kinase (TK) gene, cytosine daminase, purine nucleoside phosphorylase, and nitroreductase.

Host Cells

In exemplary aspects, the IRES inhibitor is a cell (e.g. a host cell), or a population of cells, expressing an antisense molecule described herein. In exemplary aspects, the IRES inhibitor is a host cell, or a population of host cells, comprising a recombinant expression vector encoding any of the antisense molecules described herein. Provided herein is a host cell, or a population of cells, comprising an antisense molecule described herein or an extracellular vesicle described herein. Provided herein is a cell, or a population of cells, expressing an antisense molecule described herein. Provided herein is a cell, or a population of cells, comprising a recombinant expression vector described herein. In exemplary aspects, the cell or population of cells is genetically engineered to comprise and express any one of the antisense molecules or recombinant expression vectors described herein. As used herein, the term "host cell" refers to any type of cell that may contain the antisense molecule or vector described herein. In exemplary aspects, the host cell is a eukaryotic cell, e.g., plant, animal, fungi, or algae, or may be a prokaryotic cell, e.g., bacteria or protozoa. In exemplary aspects, the host cells is a cell originating or obtained from a subject, as described herein. In exemplary aspects, the host cell originates from or is obtained from a mammal. As used herein, the term "mammal" refers to any mammal, including, but not limited to, mammals of the order Rodentia, such as mice and hamsters, and mammals of the order Logomorpha, such as rabbits. It is preferred that the mammals are from the order Carnivora, including Felines (cats) and Canines (dogs). It is more preferred that the mammals are from the order Artiodactyla, including Bo vines (cows) and S wines (pigs) or of the order Perssodactyla, including Equines (horses). It is most preferred that the mammals are of the order Primates, Ceboids, or Simoids (monkeys) or of the order Anthropoids (humans and apes). An especially preferred mammal is the human.

In exemplary aspects, the host cell is a cultured cell or a primary cell, i.e., isolated directly from an organism, e.g., a human. The host cell in exemplary aspects is an adherent cell or a suspended cell, i.e., a cell that grows in suspension. Suitable host cells are known in the art and include, for instance, DH5αE. coli cells, Chinese hamster ovarian (CHO) cells, monkey VERO cells, T293 cells, COS cells, HEK293 cells, and the like. For purposes of amplifying or replicating the recombinant expression vector, the host cell is preferably a prokaryotic cell, e.g., a DH5α cell. In exemplary aspects, the host cell is a human cell. The host cell may be of any cell type, may originate from any type of tissue, and may be of any developmental stage.

In exemplary aspects, the host cell is a mammalian, e.g., human, stem cell. In exemplary aspects, the host cell is a mammalian, e.g., human, cell of the nervous system.

Also provided by the invention is a population of cells comprising at least one host cell described herein. The population of cells may be a heterogeneous population comprising the host cell comprising any of the expression vectors described, in addition to at least one other cell, e.g., a host cell, which does not comprise any of the recombinant expression vectors. Alternatively, the population of cells may be a substantially homogeneous population, in which the population comprises mainly of host cells (e.g., consisting essentially of) comprising the expression vector. The population also may be a clonal population of cells, in which all cells of the population are clones of a single host cell comprising a recombinant expression vector, such that all cells of the population comprise the recombinant expression vector. In exemplary embodiments of the invention, the population of cells is a clonal population comprising host cells expressing a nucleic acid or a vector described herein.

Delivery Systems

In exemplary aspects, the antisense molecule is part of a delivery system, e.g., a non-viral delivery system. Delivery systems suitable for use in the methods of the present inventions and provided herein include any of those known in the art. See, e.g., Zhang et al., 2013, supra. In exemplary aspects, the delivery system is a liposome, an aptamer complex, a nanoparticle, or a dendrimer. Accordingly, the invention provides such delivery systems. The invention provides a liposome, an aptamer complex, a nanoparticle, a dendrimer, or an extracellular vesicle comprising an antisense molecule or a recombinant expression vector described herein.

In exemplary aspects, the antisense molecule is part of an aptamer-oligonucleotide conjugate. Such conjugates are described in the art. See, e.g., Liu et al., *Cancer investigation* 30:577-582 (2012). In exemplary aspects, the antisense molecule is part of a lipid-based delivery system, such as siPORT, MaxSuppressor, LipoTrust, each of which are commercially-available and described in the art. See, e.g., Wu et al., *Molecular Pharmaceutics* 8:1381-1389 (2011); Craig et al., *Leukemia* 26:2421-2424 (2012); Trang et al., *Mol Ther* 19:1116-1122 (2011); Akao et al., *Cancer Gene Ther* 17:398-408 (2010). In exemplary aspects, the antisense molecule is part of a lipid-based delivery system that is not commercially available, e.g., a $98N_{12}$-5 delivery system (Akinc et al., *Nature Biotechnology* 26:561-569 (2008); a 1,2-Di-O-octadecenyl-3-trimethylammonium propane (DOTMA):cholesterol:D-alpha-tocopheryl polyethylene glycol 1000 succinate (TPGS) lipoplex (Wu et al., *Molecular Pharmaceutics* 8:1381-1389 (2011); a dimethyldioctadecylammonium bromide (DDAB):cholesterol:TPGSlipoplex (Piao et al., *Molec Therapy* 20:1261-1269 (2012); a targeted liposome-hyaluronic acid (LPH) nanoparticle (Chen et al., *Mole Ther* 18:1650-1656 (2010); and Liu et al., *Molec Pharmaceutics* 8:250-259 (2011)); an nanotransporter interfering nanoparticle-7 (iNOP-7) (Su et al., *Nucleic Acids Res* 39:e38 (2011)); a DC-6-140-DOPE-cholesterol liposome (Rai et al., *Molec Cancer Ther* 10:1720-1727 (2011)); or a solid lipid nanoparticle (Shi et al., Systemic Delivery of microRNA-34A for Cancer Stem Cell Therapy, *Angewandte Chemie* (2013)).

In exemplary aspects, the antisense molecule is part of a polyethyleneimine (PEI) conjugate (Ibrahim et al., *Cancer Research* 71:5214-5224 (2011)); a polyurethane-short brance PEI conjugate (Chiou et al., *J Control Release* 159:240-250 (2012); a dendrimer (e.g., a poly(amidoamine) dendrimer (Ren et al., *BMC Cancer* 10:27 (2010); Ren et al., *J Biomater Sci Polym Ed* 21:303-314 (2010)); a poly(lactide-co-glycolide) (PLGA) nanoparticle (Cheng et al., *Molec Pharm* 9:1481-1488 (2012); Babar et al., *PNAS* e1695-e1704 (2012)), a disialoganglioside-targeting silica nanoparticle or a modified ultrasmall magnetic nanoparticle (Tivnan et al., *PLoS One* 7:e38129 (2012); Yigit et al., *Oncogene* 32, 1530-1538 (2013)).

In exemplary aspects, the antisense molecule is part of an extracellular vesicle, such as e.g., an exosome. Such vesicles for delivery of small RNA molecules are described in Hagiwara et al., *Drug Deliv and Transl Res* 4: 31-37 (2014); Momen-Heravi et al., *Nature Scientific Reports* 5: 09991 (2015); Wang et al., Asian PAc J Cancer Prev 16(10): 4203-4209 (2015); and International Application Publication No. WO/2014/028763; and include any vesicle in the extracellular space. In exemplary aspects, the extracellular vesicle is an exosome. In exemplary aspects, the exosome is 40-100 nm in diameter and are derived from multivescicular endosomes. In exemplary aspects, the extracellular vesicle is a microvesicle. In exemplary aspects, the microvesicle is 50-1000 nm in diameter and is generated by budding at the plasma membrane.

The present invention provides a liposome, aptamer complex, nanoparticle, dendrimer, or extracellular vesicle comprising an antisense molecule, e.g., an miRNA, which targets a portion of the IRES of the CACNAJA gene wherein the portion comprises sequence of SEQ ID NO: 180. In exemplary aspects, the liposome, aptamer complex, nanoparticle, dendrimer, or extracellular vesicle comprises an antisense molecule, e.g., miRNA, which binds to at least a portion of the sequence of SEQ ID NO: 180. In exemplary aspects, the liposome, aptamer complex, nanoparticle, dendrimer, or extracellular vesicle comprises an antisense molecule, e.g., an miRNA, which is complementary to at least a portion of the sequence of SEQ ID NO: 180. The antisense molecule, e.g., miRNA, in some aspects is complementary to at least 15 contiguous bases of said sequence. In exemplary aspects, the liposome, aptamer complex, nanoparticle, dendrimer, or extracellular vesicle comprises an antisense molecule, e.g., miRNA, which comprises at least 15 contiguous bases of SEQ ID NO: 179. In exemplary aspects, the liposome, aptamer complex, nanoparticle, dendrimer, or extracellular vesicle comprises an antisense molecule, e.g., miRNA, which comprises at least 15 contiguous bases that differ by not more than 3 bases from a portion of 15 contiguous bases of SEQ ID NO: 179. In exemplary aspects, the liposome, aptamer complex, nanoparticle, dendrimer, or extracellular vesicle comprises an antisense molecule, e.g., miRNA, which comprises at least 15 contiguous bases that is at least 90% identical to a portion of 15 contiguous bases of SEQ ID NO: 179. In exemplary aspects, the liposome, aptamer complex, nanoparticle, dendrimer, or extracellular vesicle comprises an antisense molecule, e.g., miRNA, which comprises, consists essentially of, or consists of SEQ ID NO: 179. In exemplary aspects, the miRNA is about 15, about 16, about 17, about 18, about 19, about 20, about 21, about 22, about 23, about 24 nt in length.

In exemplary aspects, the liposome, aptamer complex, nanoparticle, dendrimer, or extracellular vesicle comprises an antisense molecule, which is a precursor of miRNA comprising SEQ ID NO: 179. In exemplary aspects, the antisense molecule is a primary miRNA precursor (pri-miRNA) comprising SEQ ID NO: 179 which is optionally, capped, polyadenylated, and/or comprises double-stranded stem-loop structures. In exemplary aspects, the liposome, aptamer complex, nanoparticle, dendrimer, or extracellular vesicle comprises an antisense molecule, which is a pre-miRNA precursor comprising SEQ ID NO: 179, which is optionally about 70 to about 100 nt long and/or comprises a hairpin structure.

In exemplary aspects, the liposome, aptamer complex, nanoparticle, dendrimer, or extracellular vesicle comprises an antisense molecule, e.g., miRNA, comprising the sequence of SEQ ID NO: 179. In exemplary aspects, the the liposome, aptamer complex, nanoparticle, dendrimer, or extracellular vesicle comprises an antisense molecule, e.g., miRNA, comprising at least 15 contiguous bases of a sequence that (i) differs from SEQ ID NO: 179 by not more than 3 bases (e.g., not more than 4, 5, 6, 7, 8, 9, 10 bases), (ii) is at least 90% (e.g., at least 93%, at least 95%, at least 98%, at least 99%) identical to the sequence set forth in SEQ ID NO: 179, or (iii) is completely complementary to at least a portion of the sequence of SEQ ID NO: 180.

In exemplary aspects, the liposome, aptamer complex, nanoparticle, dendrimer, or extracellular vesicle comprises a recombinant expression vector comprising a nucleotide sequence of SEQ ID NO: 181. In exemplary aspects, the liposome, aptamer complex, nanoparticle, dendrimer, or extracellular vesicle comprises a recombinant expression vector comprising a nucleotide sequence which comprises at least 15 contiguous bases of SEQ ID NO: 181. For example, the recombinant expression vector comprises a nucleotide sequence which comprises at least or about 16 contiguous bases of SEQ ID NO: 181, at least or about 17 contiguous bases of SEQ ID NO: 181, at least or about 18 contiguous bases of SEQ ID NO: 181, at least or about 19 contiguous bases of SEQ ID NO: 181, at least or about 20 contiguous bases of SEQ ID NO: 181, at least or about 21 contiguous bases of SEQ ID NO: 181, at least or about 22 contiguous bases of SEQ ID NO: 181, at least or about 23 contiguous bases of SEQ ID NO: 181, at least or about 24 contiguous bases of SEQ ID NO: 181, at least or about 25 contiguous bases of SEQ ID NO: 181, at least or about 26 contiguous bases of SEQ ID NO: 181, at least or about 27 contiguous bases of SEQ ID NO: 181, or at least or about 28 contiguous bases of SEQ ID NO: 181. In exemplary aspects, the liposome, aptamer complex, nanoparticle, dendrimer, or extracellular vesicle comprises a recombinant expression vector comprising a nucleotide sequence that differs from SEQ ID NO: 181 by not more than 3 bases (e.g., not more than 4, 5, 6, 7, 8, 9, 10 bases). In exemplary aspects, the liposome, aptamer complex, nanoparticle, dendrimer, or extracellular vesicle comprises a recombinant expression vector comprising a nucleotide sequence which is at least 90% (e.g., at least 93%, at least 95%, at least 98%, at least 99%) identical to the sequence of SEQ ID NO: 181.

Antisense Molecules and Pharmaceutical Compositions Comprising the Same

The invention also provides any of the aforementioned IRES inhibitors. In this regard, the invention provides any of the aforementioned antisense molecules, e.g., antisense oligonucleotides, antisense nucleic acid analogs, suitable for use in the inventive methods. For purposes herein, in some aspects, the IRES inhibitor, e.g., antisense molecule, is isolated, purified, or not naturally-occurring or synthetic. The term "isolated" as used herein means having been removed from its natural environment. The term "purified" as used herein means having been increased in purity, wherein "purity" is a relative term, and not to be necessarily construed as absolute purity. As used herein, the term "not naturally-occurring" refers to a molecule or compound which is not found in nature or is non-natural. An IRES inhibitor which is not naturally-occurring is "non-naturally occurring." In exemplary aspects, an IRES inhibitor which is not naturally-occurring comprises at least one component which is not found in nature. The non-natural IRES inhibitor may comprise one or more naturally-occurring components but comprises at least one component which is not found in nature. The non-naturally occurring IRES inhibitor in some aspects comprises only naturally occurring components, but the overall structure or arrangement of the components is not found in nature. It is preferred that no insertions, deletions, inversions, and/or substitutions are present in the antisense molecules of the invention. However, it may be suitable to comprise one or more insertions, deletions, inversions, and/ or substitutions. In exemplary aspects, the antisense molecule comprises a detectable label, such as, for instance, a radioisotope, a fluorophore, or an element particle.

The antisense molecules of the invention can be constructed based on chemical synthesis and/or enzymatic ligation reactions using procedures known in the art. See, for example, Sambrook et al., Molecular Cloning: A Laboratory Manual, 3$^{rd}$ Ed., Cold Spring Harbor Press, Cold Spring Harbor, N.Y. (2001) and Ausubel et al., Current Protocols in Molecular Biology, Greene Publishing Associates and John Wiley & Sons, New York, N.Y. (1994). For example, an antisense molecule can be chemically synthesized using naturally occurring nucleotides or variously modified nucleotides designed to increase the biological stability of the molecules or to increase the physical stability of the duplex formed upon hybridization (e.g., phosphorothioate derivatives and acridine substituted nucleotides).

In exemplary aspects, the IRES inhibitor, e.g., antisense molecule, is formulated with one or more pharmaceutically acceptable carriers, diluents, and/or excipients and is provided as part of a pharmaceutical composition. In this regard, the invention further provides a pharmaceutical composition comprising any of the IRES inhibitors, e.g., antisense molecules, described herein. The pharmaceutical composition comprises one or more pharmaceutically acceptable carriers, diluents, and/or excipients, and is preferably sterile.

Depending on the route of administration, the particular IRES inhibitor intended for use, as well as other factors, the pharmaceutical composition may comprise additional pharmaceutically acceptable ingredients, including, for example, acidifying agents, additives, adsorbents, aerosol propellants, air displacement agents, alkalizing agents, anticaking agents, anticoagulants, antimicrobial preservatives, antioxidants, antiseptics, bases, binders, buffering agents, chelating agents, coating agents, coloring agents, desiccants, detergents, diluents, disinfectants, disintegrants, dispersing agents, dissolution enhancing agents, dyes, emollients, emulsifying agents, emulsion stabilizers, fillers, film forming agents, flavor enhancers, flavoring agents, flow enhancers, gelling agents, granulating agents, humectants, lubricants, mucoadhesives, ointment bases, ointments, oleaginous vehicles, organic bases, pastille bases, pigments, plasticizers, polishing agents, preservatives, sequestering agents, skin penetrants, solubilizing agents, solvents, stabilizing agents, suppository bases, surface IRES inhibitors, surfactants, suspending agents, sweetening agents, therapeutic agents, thickening agents, tonicity agents, toxicity agents, viscosity-increasing agents, water-absorbing agents, water-miscible cosolvents, water softeners, or wetting agents.

Accordingly, in some embodiments, the pharmaceutical composition comprises any one or a combination of the following components: acacia, acesulfame potassium, acetyltributyl citrate, acetyltriethyl citrate, agar, albumin, alcohol, dehydrated alcohol, denatured alcohol, dilute alcohol, aleuritic acid, alginic acid, aliphatic polyesters, alumina, aluminum hydroxide, aluminum stearate, amylopectin, α-amylose, ascorbic acid, ascorbyl palmitate, aspartame, bacteriostatic water for injection, bentonite, bentonite magma, benzalkonium chloride, benzethonium chloride, benzoic acid, benzyl alcohol, benzyl benzoate, bronopol, butylated hydroxyanisole, butylated hydroxytoluene, butylparaben, butylparaben sodium, calcium alginate, calcium ascorbate, calcium carbonate, calcium cyclamate, dibasic anhydrous calcium phosphate, dibasic dehydrate calcium phosphate, tribasic calcium phosphate, calcium propionate, calcium silicate, calcium sorbate, calcium stearate, calcium sulfate, calcium sulfate hemihydrate, canola oil, carbomer, carbon dioxide, carboxymethyl cellulose calcium, carboxymethyl cellulose sodium, β-carotene, carrageenan, castor oil, hydrogenated castor oil, cationic emulsifying wax, cellulose acetate, cellulose acetate phthalate, ethyl cellulose, microcrystalline cellulose, powdered cellulose, silicified microcrystalline cellulose, sodium carboxymethyl cellulose, cetostearyl alcohol, cetrimide, cetyl alcohol, chlorhexidine, chlorobutanol, chlorocresol, cholesterol, chlorhexidine acetate, chlorhexidine gluconate, chlorhexidine hydrochloride, chlorodifluoroethane (HCFC), chlorodifluoromethane, chlorofluorocarbons (CFC)chlorophenoxyethanol, chloroxylenol, corn syrup solids, anhydrous citric acid, citric acid monohydrate, cocoa butter, coloring agents, corn oil, cottonseed oil, cresol, m-cresol, o-cresol, p-cresol, croscarmellose sodium, crospovidone, cyclamic acid, cyclodextrins, dextrates, dextrin, dextrose, dextrose anhydrous, diazolidinyl urea, dibutyl phthalate, dibutyl sebacate, diethanolamine, diethyl phthalate, difluoroethane (HFC), dimethyl-β-cyclodextrin, cyclodextrin-type compounds such as Captisol®, dimethyl ether, dimethyl phthalate, dipotassium edentate, disodium edentate, disodium hydrogen phosphate, docusate calcium, docusate potassium, docusate sodium, dodecyl gallate, dodecyltrimethylammonium bromide, edentate calcium disodium, edtic acid, eglumine, ethyl alcohol, ethylcellulose, ethyl gallate, ethyl laurate, ethyl maltol, ethyl oleate, ethylparaben, ethylparaben potassium, ethylparaben sodium, ethyl vanillin, fructose, fructose liquid, fructose milled, fructose pyrogen-free, powdered fructose, fumaric acid, gelatin, glucose, liquid glucose, glyceride mixtures of saturated vegetable fatty acids, glycerin, glyceryl behenate, glyceryl monooleate, glyceryl monostearate, self-emulsifying glyceryl monostearate, glyceryl palmitostearate, glycine, glycols, glycofurol, guar gum, heptafluoropropane (HFC), hexadecyltrimethylammonium bromide, high fructose syrup, human serum albumin, hydrocarbons (HC), dilute hydrochloric acid, hydrogenated vegetable oil, type II, hydroxyethyl cellulose, 2-hydroxyethyl-β-cyclodextrin, hydroxypropyl cellulose, low-substituted hydroxypropyl cellulose, 2-hydroxypropyl-β-cyclodextrin, hydroxypropyl methylcellulose, hydroxypropyl methylcellulose phthalate, imidurea, indigo carmine, ion exchangers, iron oxides, isopropyl alcohol, isopropyl myristate, isopropyl palmitate, isotonic saline, kaolin, lactic acid, lactitol, lactose, lanolin, lanolin alcohols, anhydrous lanolin, lecithin, magnesium aluminum silicate, magnesium carbonate, normal magnesium carbonate, magnesium carbonate anhydrous, magnesium carbonate hydroxide, magnesium hydroxide, magnesium lauryl sulfate, magnesium oxide, magnesium silicate, magnesium stearate, magnesium trisilicate, magnesium trisilicate anhydrous, malic acid, malt, maltitol, maltitol solution, maltodextrin, maltol, maltose, mannitol, medium chain triglycerides, meglumine, menthol, methylcellulose, methyl methacrylate, methyl oleate, methylparaben, methylparaben potassium, methylparaben sodium, microcrystalline cellulose and carboxymethylcellulose sodium, mineral oil, light mineral oil, mineral oil and lanolin alcohols, oil, olive oil, monoethanolamine, montmorillonite, octyl gallate, oleic acid, palmitic acid, paraffin, peanut oil, petrolatum, petrolatum and lanolin alcohols, pharmaceutical glaze, phenol, liquified phenol, phenoxyethanol, phenoxypropanol, phenylethyl alcohol, phenylmercuric acetate, phenylmercuric borate, phenylmercuric nitrate, polacrilin, polacrilin potassium, poloxamer, polydextrose, polyethylene glycol, polyethylene oxide, polyacrylates, polyethylene-polyoxypropylene-block polymers, polymethacrylates, polyoxyethylene alkyl ethers, polyoxyethylene castor oil derivatives, polyoxyethylene sorbitol fatty acid esters, polyoxyethylene stearates, polyvinyl alcohol, polyvinyl pyrrolidone, potassium alginate, potassium benzoate, potassium bicarbonate, potassium bisulfite, potassium chloride, postassium citrate, potassium citrate anhydrous, potassium hydrogen phosphate, potassium metabisulfite, monobasic potassium phosphate, potassium propionate, potassium sorbate, povidone, propanol, propionic acid, propylene carbonate, propylene glycol, propylene glycol alginate, propyl gallate, propylparaben, propylparaben potassium, propylparaben sodium, protamine sulfate, rapeseed oil, Ringer's solution, saccharin, saccharin ammonium, saccharin calcium, saccharin sodium, safflower oil, saponite, serum proteins, sesame oil, colloidal silica, colloidal silicon dioxide, sodium alginate, sodium ascorbate, sodium benzoate, sodium bicarbonate, sodium bisulfite, sodium chloride, anhydrous sodium citrate, sodium citrate dehydrate, sodium chloride, sodium cyclamate, sodium edentate, sodium dodecyl sulfate, sodium lauryl sulfate, sodium metabisulfite, sodium phosphate, dibasic, sodium phosphate, monobasic, sodium phosphate, tribasic, anhydrous sodium propionate, sodium propionate, sodium sorbate, sodium starch glycolate, sodium stearyl fumarate, sodium sulfite, sorbic acid, sorbitan esters (sorbitan fatty esters), sorbitol, sorbitol solution 70%, soybean oil, spermaceti wax, starch, corn starch, potato starch, pregelatinized starch, sterilizable maize starch, stearic acid, purified stearic acid, stearyl alcohol, sucrose, sugars, compressible sugar, confectioner's sugar, sugar spheres, invert sugar, Sugartab, Sunset Yellow FCF, synthetic paraffin, talc, tartaric acid, tartrazine, tetrafluoroethane (HFC), theobroma oil, thimerosal, titanium dioxide, alpha tocopherol, tocopheryl acetate, alpha tocopheryl acid succinate, beta-tocopherol, delta-tocopherol, gamma-tocopherol, tragacanth, triacetin, tributyl citrate, triethanolamine, triethyl citrate, trimethyl-β-cyclodextrin, trimethyltetradecylammonium bromide, tris buffer, trisodium edentate, vanillin, type I hydrogenated vegetable oil, water, soft water, hard water, carbon dioxide-free water, pyrogen-free water, water for injection, sterile water for inhalation, sterile water for injection, sterile water for irrigation, waxes, anionic emulsifying wax, carnauba wax, cationic emulsifying wax, cetyl ester wax, microcrystalline wax, nonionic emulsifying wax, suppository wax, white wax, yellow wax, white petrolatum, wool fat, xanthan gum, xylitol, zein, zinc propionate, zinc salts, zinc stearate, or any excipient in the *Handbook of Pharmaceutical Excipients*, Third Edition, A. H. Kibbe (Pharmaceutical Press, London, UK, 2000), which is incorporated by reference in its entirety. *Remington's Pharmaceutical Sciences*, Sixteenth Edition, E. W. Martin (Mack Publishing Co., Easton, Pa., 1980), which is incorporated by reference in its entirety, discloses various components used in formulating pharmaceutically acceptable compositions and known techniques for the preparation thereof. Except insofar as any conventional agent is incompatible with the pharmaceutical compositions, its use in pharmaceutical compositions is contemplated. Supplementary active ingredients also can be incorporated into the compositions.

The pharmaceutical compositions may be formulated to achieve a physiologically compatible pH. In some embodiments, the pH of the pharmaceutical composition may be at least 5, at least 5.5, at least 6, at least 6.5, at least 7, at least 7.5, at least 8, at least 8.5, at least 9, at least 9.5, at least 10, or at least 10.5 up to and including pH 11, depending on the formulation and route of administration. In certain embodiments, the pharmaceutical compositions may comprise buffering agents to achieve a physiological compatible pH. The buffering agents may include any compounds capabale of buffering at the desired pH such as, for example, phosphate buffers (e.g.,PBS), triethanolamine, Tris, bicine, TAPS, tricine, HEPES, TES, MOPS, PIPES, cacodylate, MES, and others.

Routes of Administration

With regard to the invention, the IRES inhibitor, pharmaceutical composition comprising the same, may be administered to the subject via any suitable route of administration. The following discussion on routes of administration is merely provided to illustrate exemplary embodiments and should not be construed as limiting the scope in any way.

Formulations suitable for oral administration can consist of (a) liquid solutions, such as an effective amount of the IRES inhibitor of the present invention dissolved in diluents, such as water, saline, or orange juice; (b) capsules, sachets, tablets, lozenges, and troches, each containing a predetermined amount of the active ingredient, as solids or granules; (c) powders; (d) suspensions in an appropriate liquid; and (e) suitable emulsions. Liquid formulations may include diluents, such as water and alcohols, for example, ethanol, benzyl alcohol, and the polyethylene alcohols, either with or without the addition of a pharmaceutically acceptable surfactant. Capsule forms can be of the ordinary hard- or soft-shelled gelatin type containing, for example, surfactants, lubricants, and inert fillers, such as lactose, sucrose, calcium phosphate, and corn starch. Tablet forms can include one or more of lactose, sucrose, mannitol, corn starch, potato starch, alginic acid, microcrystalline cellulose, acacia, gelatin, guar gum, colloidal silicon dioxide, croscarmellose sodium, talc, magnesium stearate, calcium stearate, zinc stearate, stearic acid, and other excipients, colorants, diluents, buffering agents, disintegrating agents, moistening agents, preservatives, flavoring agents, and other pharmacologically compatible excipients. Lozenge forms can comprise the IRES inhibitor of the present invention in a flavor, usually sucrose and acacia or tragacanth, as well as pastilles comprising the IRES inhibitor of the present invention in an inert base, such as gelatin and glycerin, or sucrose and acacia, emulsions, gels, and the like containing, in addition to, such excipients as are known in the art.

The IRES inhibitor s of the present invention, alone or in combination with other suitable components, can be delivered via pulmonary administration and can be made into aerosol formulations to be administered via inhalation. These aerosol formulations can be placed into pressurized acceptable propellants, such as dichlorodifluoromethane, propane, nitrogen, and the like. They also may be formulated as pharmaceuticals for non-pressured preparations, such as in a nebulizer or an atomizer. Such spray formulations also may be used to spray mucosa. In some embodiments, the IRES inhibitor is formulated into a powder blend or into microparticles or nanoparticles. Suitable pulmonary formulations are known in the art. See, e.g., Qian et al., Int J Pharm 366: 218-220 (2009); Adjei and Garren, Pharmaceutical Research, 7(6): 565-569 (1990); Kawashima et al., J Controlled Release 62(1-2): 279-287 (1999); Liu et al., Pharm Res 10(2): 228-232 (1993); International Patent Application Publication Nos. WO 2007/133747 and WO 2007/141411.

Formulations suitable for parenteral administration include aqueous and non-aqueous, isotonic sterile injection solutions, which can contain anti-oxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. The term, "parenteral" means not through the alimentary canal but by some other route such as subcutaneous, intramuscular, intraspinal, or intravenous. The IRES inhibitor of the present invention can be administered with a physiologically acceptable diluent in a pharmaceutical carrier, such as a sterile liquid or mixture of liquids, including water, saline, aqueous dextrose and related sugar solutions, an alcohol, such as ethanol or hexadecyl alcohol, a glycol, such as propylene glycol or polyethylene glycol, dimethylsulfoxide, glycerol, ketals such as 2,2-dimethyl-153-dioxolane-4-methanol, ethers, poly(ethyleneglycol) 400, oils, fatty acids, fatty acid esters or glycerides, or acetylated fatty acid glycerides with or without the addition of a pharmaceutically acceptable surfactant, such as a soap or a detergent, suspending agent, such as pectin, carbomers, methylcellulose, hydroxypropylmethylcellulose, or carboxymethylcellulose, or emulsifying agents and other pharmaceutical adjuvants.

Oils, which can be used in parenteral formulations include petroleum, animal, vegetable, or synthetic oils. Specific examples of oils include peanut, soybean, sesame, cottonseed, corn, olive, petrolatum, and mineral. Suitable fatty acids for use in parenteral formulations include oleic acid, stearic acid, and isostearic acid. Ethyl oleate and isopropyl myristate are examples of suitable fatty acid esters.

The parenteral formulations in some embodiments contain from about 0.5% to about 25% by weight of the IRES inhibitor of the present invention in solution. Preservatives and buffers may be used. In order to minimize or eliminate irritation at the site of injection, such compositions may contain one or more nonionic surfactants having a hydrophile-lipophile balance (HLB) of from about 12 to about 17. The quantity of surfactant in such formulations will typically range from about 5% to about 15% by weight. Suitable surfactants include polyethylene glycol sorbitan fatty acid esters, such as sorbitan monooleate and the high molecular weight adducts of ethylene oxide with a hydrophobic base, formed by the condensation of propylene oxide with propylene glycol. The parenteral formulations in some aspects are presented in unit-dose or multi-dose sealed containers, such as ampoules and vials, and can be stored in a freeze-dried (lyophilized) condition requiring only the addition of the sterile liquid excipient, for example, water, for injections, immediately prior to use. Extemporaneous injection solutions and suspensions in some aspects are prepared from sterile powders, granules, and tablets of the kind previously described.

Injectable formulations are in accordance with the invention. The requirements for effective pharmaceutical carriers for injectable compositions are well-known to those of ordinary skill in the art (see, e.g., *Pharmaceutics and Pharmacy Practice*, J. B. Lippincott Company, Philadelphia, Pa., Banker and Chalmers, eds., pages 238-250 (1982), and *ASHP Handbook on Injectable Drugs*, Toissel, 4th ed., pages 622-630 (1986)).

Additionally, the IRES inhibitors of the invention can be made into suppositories for rectal administration by mixing with a variety of bases, such as emulsifying bases or water-soluble bases. Formulations suitable for vaginal administration can be presented as pessaries, tampons, creams, gels, pastes, foams, or spray formulas containing, in addition to the active ingredient, such carriers as are known in the art to be appropriate.

It will be appreciated by one of skill in the art that, in addition to the above-described pharmaceutical compositions, the IRES inhibitor of the invention can be formulated as inclusion complexes, such as cyclodextrin inclusion complexes, or liposomes.

In exemplary aspects, wherein the IRES inhibitor is an antisense molecule, the antisense molecule may be formulated into a viral vector or a nonviral vector, either of which are suitable for delivery into humans. Li et al., *Cancer Gene Ther* 8:555-565 (2001) describes methods of targeted gene therapy by non viral vectors. Chen et al., *Mol Ther* describes gene therapy with a lentiviral gene delivery construct. Zhou et al., *J Healthc Eng* 4(2): 223-254 (2013) and Chen et al., *Cardiovasc Ultrasound* 11:11 (2013) describes gene deliver with ultrasound. See, e.g., Chistiakov et al., *Drug Deliv* 19(8): 392-405 (2012) and Juliano et al., *J Drug Target* 21(1): 27-43(2013) and Southwell et al., *Trends Mol Med* 18(11): 634-643 (2012) and International Patent Application Publication Nos. WO2005/072703, WO1994/023699;

WO2010/085665, and WO1998/018811. Examples 8 and 9 describe delivery of an exemplary miRNA through delivery of an adenoviral vector.

Dosages

For purposes herein, the amount or dose of the IRES inhibitor administered should be sufficient to effect, e.g., a therapeutic or prophylactic response, in the subject or animal over a reasonable time frame. For example, the dose of the IRES inhibitor of the present invention should be sufficient to treat SCA6 as described herein in a period of from about 1 to 4 minutes, 1 to 4 hours or 1 to 4 weeks or longer, e.g., 5 to 20 or more weeks, from the time of administration. In certain embodiments, the time period could be even longer. The dose will be determined by the efficacy of the particular IRES inhibitor and the condition of the animal (e.g., human), as well as the body weight of the animal (e.g., human) to be treated.

Many assays for determining an administered dose are known in the art. For purposes herein, an assay, which comprises comparing the extent to which SCA6 is treated upon administration of a given dose of the IRES inhibitor of the present invention to a mammal among a set of mammals, each set of which is given a different dose of the IRES inhibitor, could be used to determine a starting dose to be administered to a mammal. The extent to which SCA6 is treated upon administration of a certain dose can be represented by, for example, the extent to which the expression of α1ACT is reduced. Methods of measuring protein expression are known in the art, including, for instance, the methods described in the EXAMPLES set forth below.

The dose of the IRES inhibitor of the present invention also will be determined by the existence, nature and extent of any adverse side effects that might accompany the administration of a particular IRES inhibitor of the present invention. Typically, the attending physician will decide the dosage of the IRES inhibitor of the present invention with which to treat each individual patient, taking into consideration a variety of factors, such as age, body weight, general health, diet, sex, IRES inhibitor of the present invention to be administered, route of administration, and the severity of the condition being treated. By way of example and not intending to limit the scope of the claimed subject matter, the dose of the IRES inhibitor of the present invention can be about 0.0001 to about 1 g/kg body weight of the subject being treated/day, from about 0.0001 to about 0.001 g/kg body weight/day, or about 0.01 mg to about 1 g/kg body weight/day.

Controlled Release Formulations

In some embodiments, the IRES inhibitors described herein can be modified into a depot form, such that the manner in which the IRES inhibitor is released into the body to which it is administered is controlled with respect to time and location within the body (see, for example, U.S. Pat. No. 4,450,150). Depot forms of IRES inhibitors of the invention can be, for example, an implantable composition comprising the IRES inhibitors and a porous or non-porous material, such as a polymer, wherein the IRES inhibitor is encapsulated by or diffused throughout the material and/or degradation of the non-porous material. The depot is then implanted into the desired location within the body of the subject and the IRES inhibitor is released from the implant at a predetermined rate.

The pharmaceutical composition comprising the IRES inhibitor in certain aspects is modified to have any type of in vivo release profile. In some aspects, the pharmaceutical composition is an immediate release, controlled release, sustained release, extended release, delayed release, or biphasic release formulation. Methods of formulating small molecular weight compounds, peptides, and oligonucleotides or nucleic acid analogs, for controlled release are known in the art. See, for example, Qian et al., *J Pharm* 374: 46-52 (2009) and International Patent Application Publication Nos. WO 2008/130158, WO2004/033036; WO2000/032218; and WO 1999/040942.

The instant compositions may further comprise, for example, micelles or liposomes, or some other encapsulated form, or may be administered in an extended release form to provide a prolonged storage and/or delivery effect.

Timing of Administration

The disclosed pharmaceutical compositions and formulations may be administered according to any regimen including, for example, daily (1 time per day, 2 times per day, 3 times per day, 4 times per day, 5 times per day, 6 times per day), every two days, every three days, every four days, every five days, every six days, weekly, bi-weekly, every three weeks, monthly, or bi-monthly. Timing, like dosing can be fine-tuned based on dose-response studies, efficacy, and toxicity data, and initially gauged based on timing used for other antibody therapeutics.

Combinations

In some embodiments, the IRES inhibitors described herein are administered alone, and in alternative embodiments, the IRES inhibitors described herein are administered in combination with another therapeutic agent, e.g., another IRES inhibitor of the invention of different type (e.g., structure) or a completely different therapeutic agent.

In exemplary aspects, the IRES inhibitors described herein are administered in combination with a compound which targets one of the following genes: Bcat1, Bdkrb2, Bmp3, Ces1a, Chst1, Crabp1, Dapk1, Dbh, Foxq1, Gabbr2, Gfra1, Gnai1, Hsd11b1, IL17re, Iqsec3, Mb21d2, Mmp13, Nnat, Npy1r, Ntn1, Pmp22, Podx1, Prkcdbp, Ramp1, Rbp4, Reep1, Rgs10, S100a4, S100a5, S100a6, Sema3b, Sgce, Sh3bgr, Smoc2, Tbc1d9, Ugt8, V1dlr. The mRNA encoded by each of these genes are provided in the Sequence Listing as SEQ ID NOs: 64-137. In exemplary aspects, the IRES inhibitors described herein are administered in combination with a compound which targets a gene product encoded by one of these genes.

In alternative or additional aspects, the IRES inhibitors described herein are administered in combination with a compound which targets one of the following genes, which are related to neuron differentiation: Vgf, Ntn1, Slc11a, Lhx2, Nrp1, Mab2, Ret, Etv4, Btg2, Cspg5, Sptbn4, Rab3a, Lamb2, Celsr3, Ntrk1, Mapk8ip3, Cln8, Nnat, Bmp7, Brsk1, Sema5a, Plxna3, Fgfr1. In exemplary aspects, the IRES inhibitors described herein are administered in combination with a compound which targets a gene product encoded by one of these genes.

In alternative or additional aspects, the IRES inhibitors described herein are administered in combination with a compound which targets one of the following genes, which are related to the cell cycle: Suv39h2, Ndc80, Rad51, Trip13, Cenpf, Ccnb1, SMC4, SMC2, Kif11, Cep55, Kif18a, Dlgap5, Lzts2, Katna1, Mih1, Mns1, Rps6. In exemplary aspects, the IRES inhibitors described herein are administered in combination with a compound that targets a gene product encoded by one of these genes.

In addition to the inventive methods comprising administering an IRES inhibitor, provided herein are alternative methods of treating SCA6 in a subject, comprising the step of administering to the subject (I) a compound which targets one or more genes other than the CACNA1A gene, wherein the one or more genes is selected from the group consisting of: Bcat1, Bdkrb2, Bmp3, Ces1a, Chst1, Crabp1, Dapk1, Dbh, Foxq1, Gabbr2, Gfra1, Gnai1, Hsd11b1, IL17re, Iqsec3, Mb21d2, Mmp13, Nnat, Npy1r, Ntn1, Pmp22, Podx1, Prkcdbp, Ramp1, Rbp4, Reep1, Rgs10, S100a4, S100a5, S100a6, Sema3b, Sgce, Sh3bgr, Smoc2, Tbc1d9, Ugt8, V1dlr, Vgf, Ntn1, S1c11a, Lhx2, Nrp1, Mab2, Ret, Etv4, Btg2, Cspg5, Sptbn4, Rab3a, Lamb2, Celsr3, Ntrk1, Mapk8ip3, Cln8, Nnat, Bmp7, Brsk1, Sema5a, Plxna3, Fgfr1, Suv39h2, Ndc80, Rad51, Trip13, Cenpf, Ccnb1, SMC4, SMC2, Kif11, Cep55, Kif18a, Dlgap5, Lzts2, Katna1, Mih1, Mns1, and Rps6, or (II) a compound which targets a gene product encoded by said gene.

Kits

In some embodiments, the IRES inhibitor is provided as part of a kit or package or unit dose. "Unit dose" is a discrete amount of a therapeutic composition dispersed in a suitable carrier. Accordingly, provided herein are kits comprising an IRES inhibitor of the invention. In exemplary aspects, the kit comprises an antisense molecule as described herein.

In some embodiments, the components of the kit/unit dose are packaged with instructions for administration to a subject. In some embodiments, the kit comprises one or more devices for administration to a subject, e.g., a needle and syringe, a dropper, a measuring spoon or cup or like device, an inhaler, and the like. In some aspects, the IRES inhibitor is pre-packaged in a ready to use form, e.g., a syringe, an intravenous bag, an inhaler, a tablet, capsule, etc. In some aspects, the kit further comprises other therapeutic or diagnostic agents or pharmaceutically acceptable carriers (e.g., solvents, buffers, diluents, etc.), including any of those described herein. In particular aspects, the kit comprises an IRES inhibitor of the invention along with the current SCA6 standard of care.

The following examples further illustrate the invention but, of course, should not be construed as in any way limiting its scope.

EXAMPLES

Example 1

This example demonstrates an miRNA-mediated therapy for SCA6 which provides a selective translational block of the CACNA1A second cistron.

Spinocerebellar ataxia type 6 (SCA6) is a dominantly-inherited neurodegenerative disease characterized by progressive ataxia and Purkinje cell degeneration and caused by abnormal expansions of the polyglutamine (polyQ) tract in CACNA1A. Recently, it was discovered that SCA6 is attributable to the expression of a polyQ repeat expansion within a second CACNA1A gene product, α1ACT and α1ACT expression is under the control of internal ribosomal entry site (IRES) within the CACNA1A gene coding region. Here it is shown that miR-3191-5p bound to Argonaute protein-4 preferentially inhibits the translational initiation of α1ACT by eukaryotic initiation factors, eIF4AII and eIF4GII, which directly act on CACNA1A IRES and enhance α1ACT translation. Furthermore, adeno-associated viral delivery of miR-3191-5p ameliorates the Purkinje cell degeneration and ataxia caused by SCA6-associated α1ACT in our mouse model. These results suggest that miRNA-mediated selective translational block of second cistron could be potential therapeutic targets in diseases caused by IRES-driven pathogenic gene products.

Presently there are no definitive treatments for neurodegenerative diseases which, based on the diversity of mechanisms, may require precision medicine. Spinocerebellar ataxia type 6 (SCA6) is one of the most common forms of autosomal dominant SCA, representing 10-20% of patients with dominantly-inherited ataxia and approximately 5/100,000 (1-3). Patients with SCA6 develop slowly progressive cerebellar ataxia usually beginning at age 40-50 years associated with extensive selective Purkinje cell degeneration (4, 5). The mutational mechanism responsible for SCA6 is an expanded polyglutamine (polyQ)-encoding CAG repeat in the gene, CACNA1A, thought originally only to encode the α1A (Cav2.1, P/Q-type) voltage-gated Ca2+ channel subunit (2, 6). Attempts to implicate a disturbance of P/Q channel kinetics in SCA6 have been unsuccessful (7, 8). It has been discovered that the CACNA1A gene, is a bicistronic cellular gene, i.e., it encodes two structurally unrelated proteins, with distinct functions, that are separately encoded within the same transcript (9). CACNA1A encodes both α1A subunit and a newly recognized transcription factor, α1ACT, within an overlapping open reading frame (ORF) of the same mRNA. This is achieved by the presence of a novel internal ribosomal entry site (IRES) upstream of a second ORF encoding α1ACT. α1ACT bearing the polyQ expansion ($\alpha1ACT_{SCA6}$) impairs its cellular and molecular functions, and $\alpha1ACT_{SCA6}$ causes increased cell death in cultured cell models and cerebellar atrophy and dysfunction in a transgenic mouse model (9). As a potential therapy, ablation or elimination of complete CACNA1A expression would be lethal (9, 10), although selective elimination of α1ACT protein could be a viable strategy. MicroRNAs (MiRNAs) have been increasingly recognized to play a role in the regulation of gene expression, in many cases by both translational repression and mRNA destabilization (11, 12), but to date have not been used to preferentially regulate the translation of disease genes driven by cellular IRES. Although prevailing evidence has pointed to the role of natural miRNAs in gene silencing and translational repression by binding to 3' untranslated region (UTR) (or rarely 5' UTR) of targeted mRNAs (11-16), predicted miRNA binding sites are found throughout the genome including both coding and non coding regions (17, 18).

Figure 6:
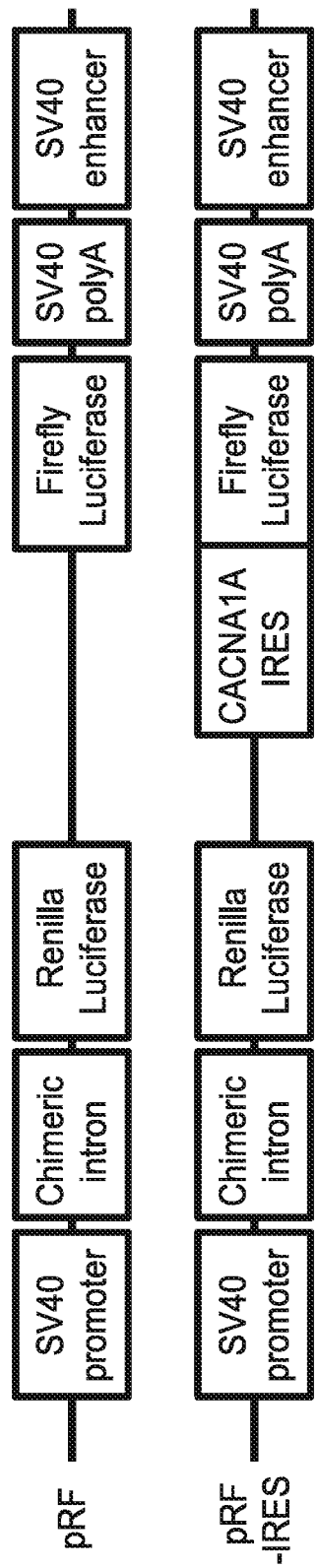
FIG. 6 demonstrates the preparation of a bicistronic CACNA1A IRES reporter vector. Schematic representations of a bicistronic control reporter vector (pRF) and a bicistronic CACNA1A IRES reporter vector (pRF-IRES). SV40: simian virus 40; polyA: polyadenylation signal sequence.
Figure 7A:
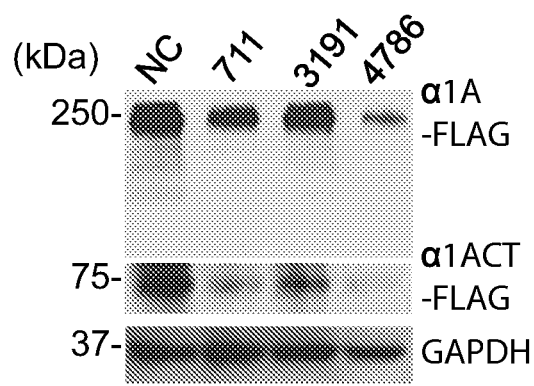
FIGS. 7A-7B evidence that miR-3191-5p inhibits the IRES-driven translation of α1ACT$_{WT}$ while sparing α1A$_{WT}$ expression and α1A$_{WT}$ mRNA levels, while miR-711 and -4786 down-regulate α1A$_{WT}$ protein and mRNA in HEK293 cells.
Figure 7B:
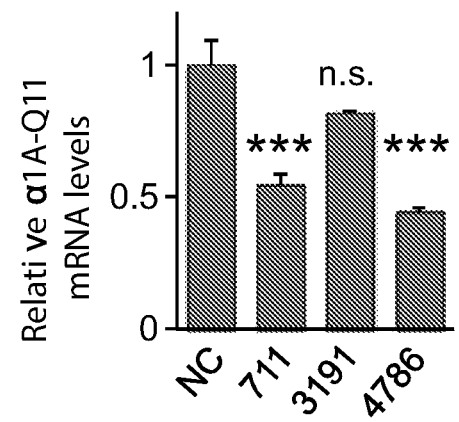
Figure 9:
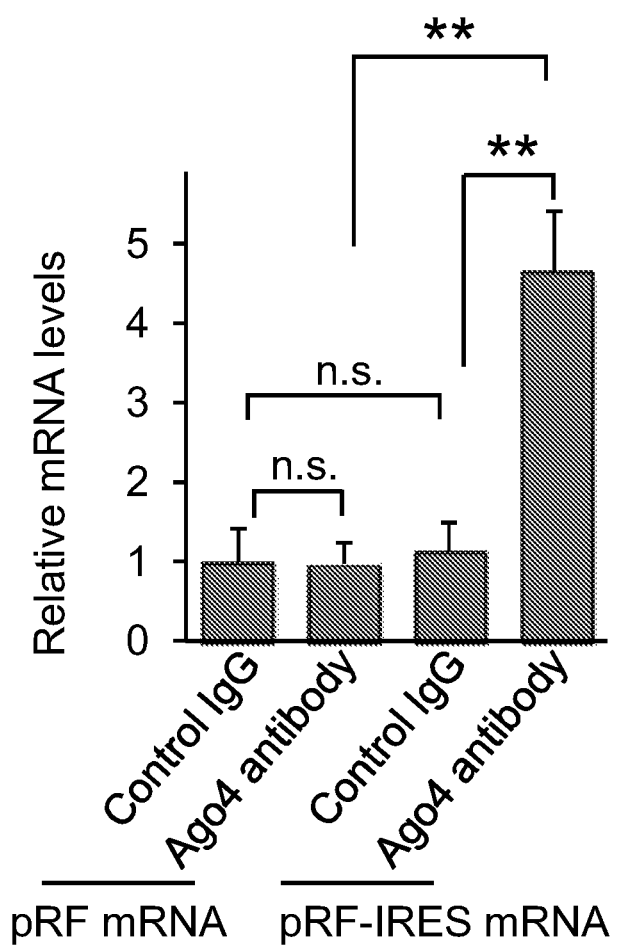
FIG. 9 demonstrates that Ago4 preferentially binds to CACNA1A IRES. We also performed an immunoprecipitation-coupled qRT-PCR using a bicistronic control (pRF) or CACNA1A IRES reporter vector (pRF-IRES) in HEK293 cells. Compared to the case of pRF vector, Ago4-specific antibodies preferentially precipitated mRNA transcribed from pRF-IRES vector than control IgG. Data are means±S.E.M. **P<0.01. n.s.: not significant.

The CentroidFold program (19) was used to predict that CACNA1A IRES has a stem-loop structure that plays an important role in IRES-driven translation of α1ACT (9). The miRNA_Targets program (17) demonstrates that miRNAs, miR-711 (Accession number_MIMAT0012734), -3191-5p (Accession number_MIMAT0022732), and -4786-3p (Accession number_MIMAT0019955) bind to sequences within the stem-loop structure of CACNA1A IRES (FIG. 5A to FIG.C). To examine the effects of these miRNAs on CACNA1A IRES-driven translation, miRNAs with either a bicistronic IRES reporter vector or control vector were co-transfected into HEK293 cells (FIG. 6). Dual luciferase assays revealed that miR-711, -3191-5p, and -4786-3p significantly down-regulated the CACNA1A IRES-driven luciferase activities compared to a miRNA negative control (FIG. 1A). The effects of these miRNAs on CACNA1A-encoded C-terminal FLAG-tagged peptides (α1A-FLAG and α1ACT-FLAG) were tested with the pathological polyQ tract (Q33) in transfected HEK293 cells. Although miR-711 and -786-3p decreased both α1A-FLAG and α1ACT-FLAG expression, miR-3191-5p down-regulated α1ACT-FLAG expression, but spared α1A-FLAG expression (FIG. 1B). This was the case with α1A bearing both normal (Q11) and SCA6 (Q33) alleles (FIG. 7A). Quantitative real time-PCR (qRT-PCR) studies of total RNA showed that miR-711 and -4786-3p significantly decreased CACNA1A mRNA (α1A mRNA) levels relative to a miRNA negative control, but that miR-3191-5p did not affect α1A mRNA levels (FIG. 1C, FIG. 7B). To determine whether miR-3191-5p interacts with regions within the α1A mRNA other than the CACNA1A IRES, mutated CACNA1A IRES templates, resistant to the binding of miR-3191-5p (CACNA1A IRESmut: FIG. 1D, FIG. 8A and FIG. 8B) were prepared. CACNA1A IRESmut functioned normally both in the IRES dual luciferase assay and in α1A-FLAG and α1ACT-FLAG expressing HEK293 cells, but the inhibition by miR-3191-5p was prevented (FIG. 1E and FIG. 1F). Finally, miR-3191-5p did not affect the expression levels of endogenous α1A mRNA harboring the native 3'UTR sequence in HEK293 cells (FIG. 1G). These findings demonstrated that miR-3191-5p directly interacted with CACNA1A IRES and inhibited IRES-driven translation of α1ACT while sparing α1A expression.

miRNAs generally act on targeted mRNA in collaboration with the miRNA-induced silencing complex (miRISC)-guided Argonaute (Ago) proteins (20-24), although detailed mechanisms of the role of the four identified subtypes in translational repression remain to be determined. To examine the role of Ago proteins in the inhibitory effects of miR-3191-5p, miR-3191-5p were co-transfected with small interfering RNAs (siRNAs) targeting Ago1-4 and either a bicistronic IRES reporter vector or control vector into HEK293 cells. Dual luciferase assay revealed that the knockdown of Ago4, but not Ago1-3, blocked the silencing effects of miR-3191-5p on the CACNA1A IRES-driven luciferase activities (FIG. 1H). Western blot analysis showed that the silencing of Ago4, but not Ago1-3, also prevented the down-regulation of α1ACT-FLAG expression by miR-3191-5p (FIG. 1I). RNA immunoprecipitation (IP)-coupled qRT-PCR revealed the binding affinities of Ago4 to both miR-3191-5p and CACNA1A IRES (FIG. 1J and FIG. 1K, FIG. 9A and FIG. 9B). While previous studies have mainly focused on the interaction of Ago1 and Ago2 with miRNAs on the 3' UTR of targeted mRNA, human Ago4 has been reported to be catalytically inactive (22-24).

Figure 10A:
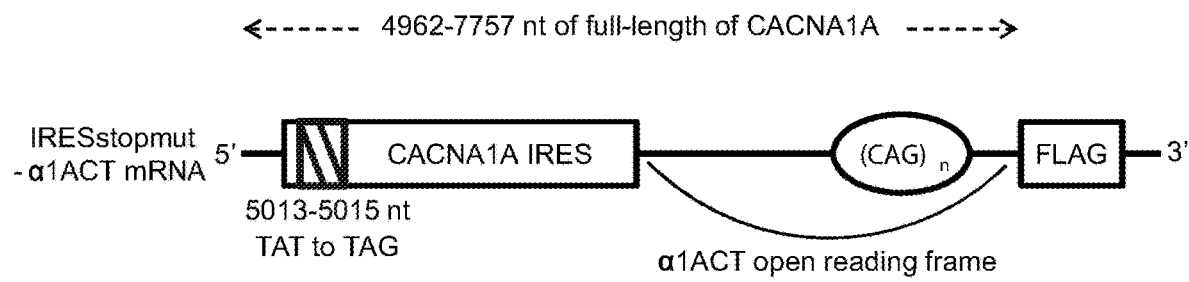
FIGS. 10A-10B demonstrate the preparation of truncated transgenes of CACNA1A second cistron that lack the sequence of 5' up-stream from CACNA1A IRES (IRESstopmut-α1ACT).
Figure 10B:
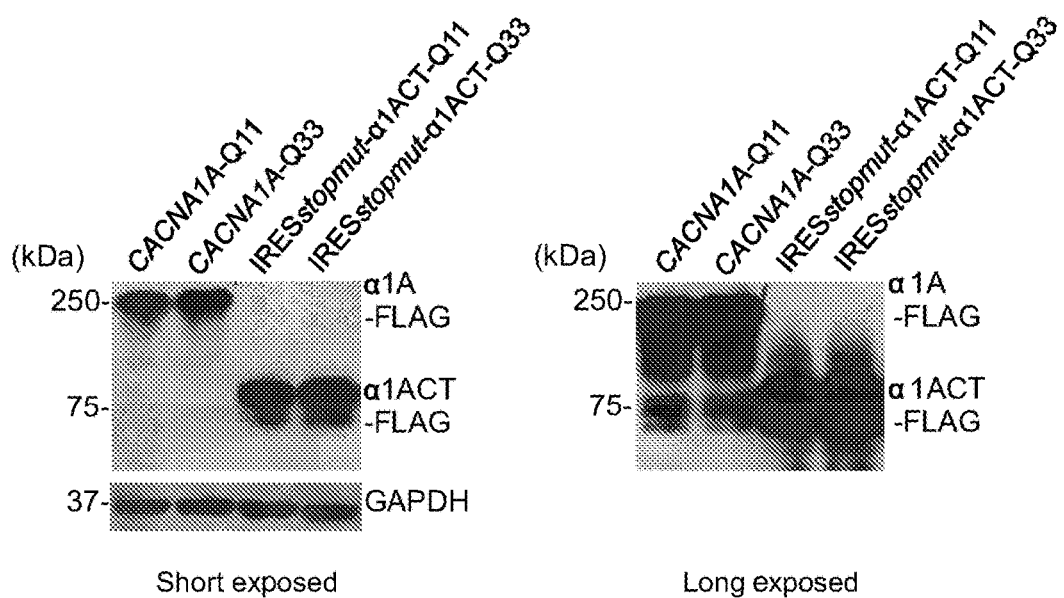

Both eukaryotic initiation factors (eIFs), eIF4A and eIF4G, have been previously shown to be involved in the IRES-dependent translation in several types of virus IRESs (12), but have not been studied well in the context of mammalian IRES and regulation by miRNA. The effects of eIF4AI, eIF4AII, eIF4GI, and eIF4GII on CACNA1A IRES-driven translation were examined using our dual luciferase reporter assay. Over-expression of either eIF4AII or eIF4GII, but not eIF4AI and eIF4GI increased the CACNA1A IRES-driven luciferase activities. The effects of eIF4AII and eIF4GII were blocked by co-transfection with miR-3191-5p (FIG. 2A). Similarly, using the vector expressing α1A-FLAG and α1ACT-FLAG, it was found that over-expression of either eIF4AII or eIF4GII increased both α1A-FLAG and α1ACT-FLAG expression by western blot analysis, and that miR-3191-5p reversed the up-regulating effects of eIF4AII and eIF4GII on α1ACT-FLAG expression without affecting the eIF4AII and eIF4GII expression, respectively (FIG. 2B). Over-expression of either eIF4AII or eIF4GII did not affect the expression levels of α1A mRNA in qRT-PCR assays (FIG. 2C). The effects of miR-3191-5p depended on the interactions with CACNA1A IRES, because when the CACNA1A IRESmut vectors that were resistant to miR-3191-5p binding were used, miR-3191-5p did not block the up-regulating effects of eIF4AII and eIF4GII on CACNA1A IRES-driven luciferase activities (FIG. 2D) and α1ACT-FLAG expression (FIG. 2E). It was also found that eIF4AII associated with eIF4GII (FIG. 2F), which was consistent with the results of recent reports (25, 26). Dual luciferase assay revealed that eIF4GII, rather than eIF4AII, played a critical role in the initiation of the CACNA1A IRES-driven translation (FIG. 2G). Finally, the binding affinities of both eIF4AII and eIF4GII to CACNA1A IRES were tested using truncated transgenes of CACNA1A second cistron that lacked the sequence of 5' up-stream from CACNA1A IRES (IRESstopmut-α1ACT: FIG. 10A and FIG. 10B), because both eIF4AII and eIF4GII affected not only CACNA1A-IRES driven translation of α1ACT but also cap-dependent α1A translation (FIG. 2B). RNA IP-coupled qRT-PCR revealed that both eIF4AII-specific and eIF4GII-specific antibodies precipitate mRNA transcribed from IRESstopmut-α1ACT vectors and that miR-3191-5p significantly decreased the binding affinities of both eIF4AII and eIF4GII to CACNA1A IRES (FIG. 2H). Based on these findings, it was concluded that miR-3191-5p, in collaboration with Ago4, inhibits the initiation of IRES-driven translation of α1ACT by the complex of eIF4AII and eIF4GII that directly acts on CACNA1A IRES to enhance IRES-driven translation.

Figure 3F:
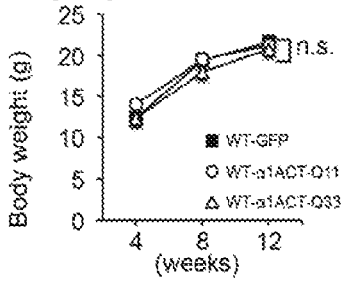
Figure 3G:
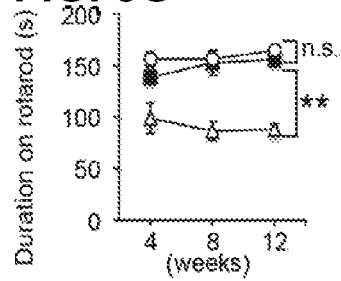
Figure 3H:
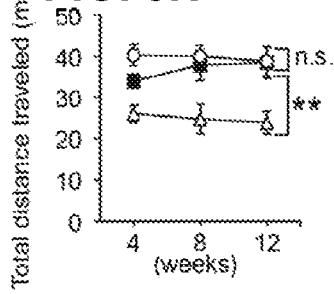
Figure 11A:
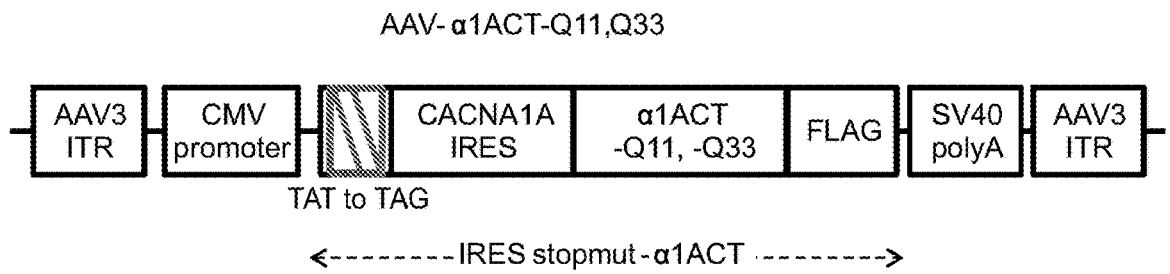
FIGS. 11A-11C demonstrate the widespread viral transduction throughout the brain and cerebellum of WT mice injected with AAV.
Figure 11B:
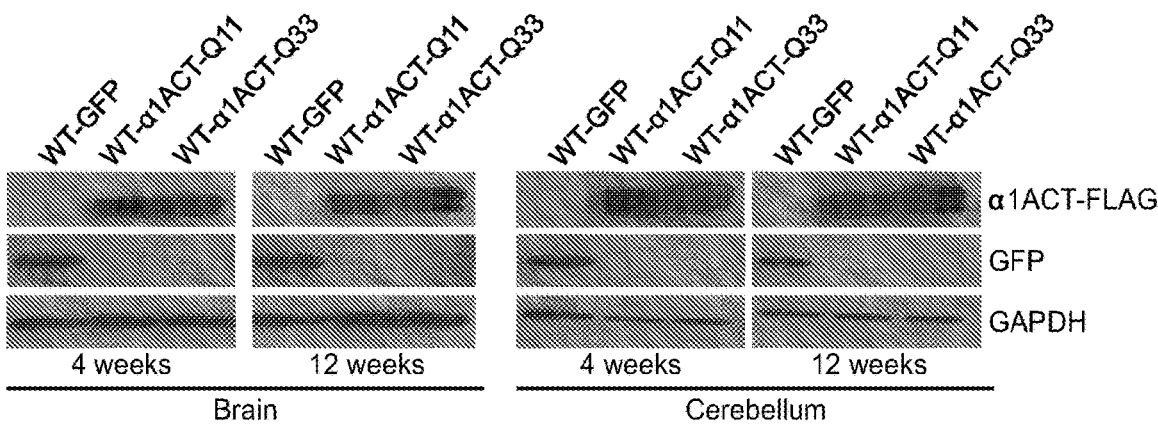
Figure 11C:
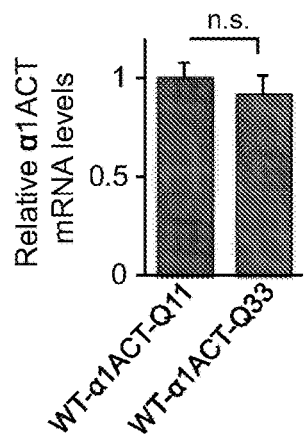

It has already characterized the independent physiological and cellular pathological properties of wild type (WT) α1ACT and α1ACT$_{SCA6}$ (9) in vivo although these transgenes lacked the CACNA1A IRES and produced a rather mild phenotype. Elimination of the portion of CACNA1A IRES sequence from the human mRNA encoding α1A-Q33 selectively eliminates the expression of α1ACT fragment and is protective in a cell culture model of α1ACT$_{SCA6}$ toxicity without affecting α1A expression (9). It was reasoned that targeted expression of α1ACT, in which translation of α1ACT is under the control of CACNA1A IRES, would more accurately resemble SCA6 pathogenesis in a mouse model, while providing a suitable target for IRES-directed miRNA based therapy. Thus, an in vivo adeno-associated viral (AAV) delivery system was developed using the constructs of α1ACT transgene tagged with a C-terminal FLAG epitope, expressed under the control of CACNA1A IRES (AAV-α1ACT-Q11, or -Q33) (FIG. 11A). The control AAV vector expressing Aequorea coerulescens green fluorescent protein (GFP) (AAV-GFP) was also prepared. A viral load of $10^9$ vector genomes (vg) of each of these constructs was directly injected into the right lateral ventricle of neonatal WT mice of C57/BL6J at post-natal day 1. Four weeks after AAV vector injection, AAV-injected WT mice were sacrificed and a widespread transduction of the viral particles was found throughout the mouse brain and cerebellum. Western blot analysis revealed the strong expression of GFP, α1ACT-Q11-FLAG, or α1ACT-Q33-FLAG in the brain and cerebellum of WT mice injected with AAV-GFP (WT-GFP mice), AAV-α1ACT-Q11 (WT-α1ACT-Q11 mice), or AAV-α1ACT-Q33 (WT-α1ACT-Q33 mice) (FIG. 11B). The persistent expression of GFP, α1ACT-Q11-FLAG, or α1ACT-Q33-FLAG was confirmed for at least 12 weeks of our observation period (FIG. 11B). qRT-PCR studies of total RNA from the cerebellum of WT-α1ACT-Q11 mice and WT-α1ACT-Q33 mice showed that the expression levels of mRNA transcribed from the transgenes delivered by AAV were comparable (FIG. 11C). The presence of the AAV vector in the Purkinje cells of AAV-injected WT mice was visually confirmed by the co-localization of GFP or FLAG and staining for calbindin, a Purkinje cell marker (FIG. 3A). As compared to WT-GFP mice and WT-α1ACT-Q11 mice, WT-α1ACT-Q33 mice showed significant thinning of the molecular layer, decrease in the density of dendritic tree and number of Purkinje cells in the cerebellum (FIG. 3B to FIG. 3E). Although WT-α1ACT-Q33 mice grew at roughly the same body weight as WT-GFP mice and WT-α1ACT-Q11 mice (FIG. 3F), WT-α1ACT-Q33 mice showed significant defects in motor functions assessed by rotarod (FIG. 3G), activities by open field assay (FIG. 3H), and gait stability by a video-assisted computerized treadmill (FIG. 12A to FIG. 12F). The Digigait assay revealed that WT-α1ACT-Q33 mice exhibited shorter stride length (FIG. 12A, FIG. 12C, and FIG. 12E) and greater stride frequencies (FIG. 12B, FIG. 12D, and FIG. 12F) from 4 weeks old, indicating progressive instability during walking. These findings indicated that viral administration and expression of α1ACT$_{SCA6}$ under the control of CACNA1A IRES resembled the pathological and clinical features of SCA6 (3, 4).

Figure 4A:
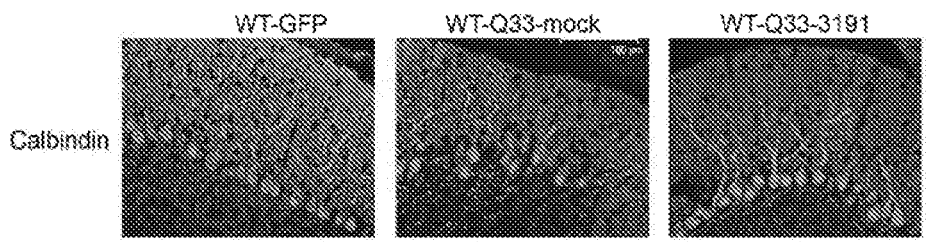
FIGS. 4A-4G evidence the therapeutic effects of treatment with the viral administration of miR-3191-5p on the mouse phenotypes induced by AAV-mediated delivery of α1ACT$_{SCA6}$.
Figure 4B:
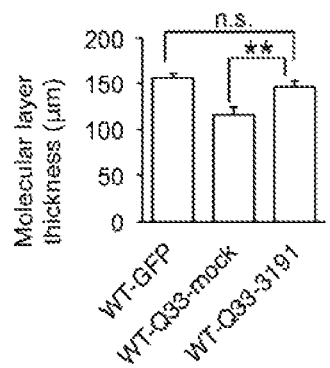
Figure 4C:
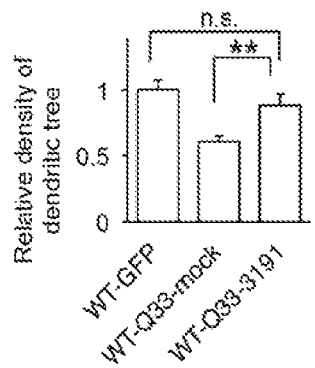
Figure 4D:
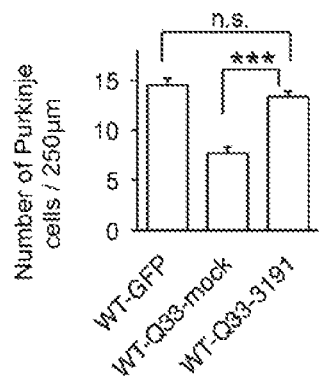
Figure 4E:
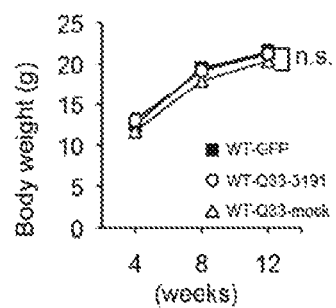
Figure 4F:
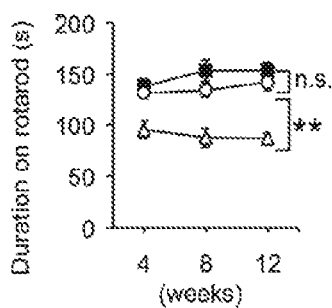
Figure 4G:
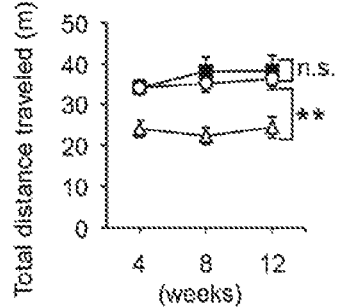
Figure 13A:
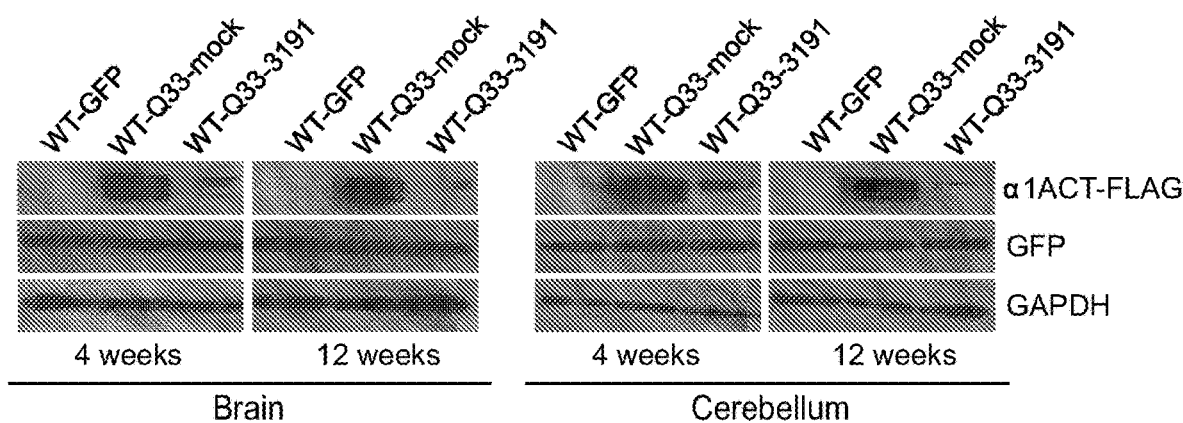
FIGS. 13A-13B evidence the widespread viral transduction throughout the brain and cerebellum of WT mice injected with AAV.
Figure 13B:
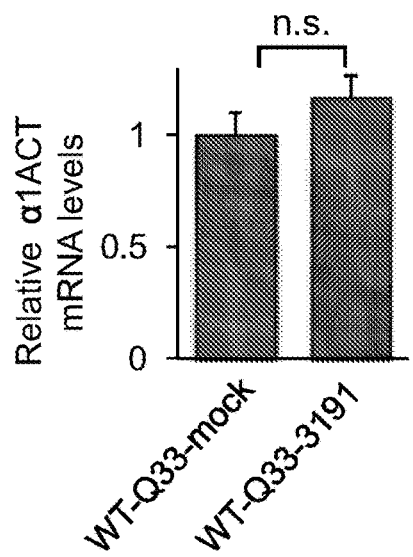
Figure 14A:
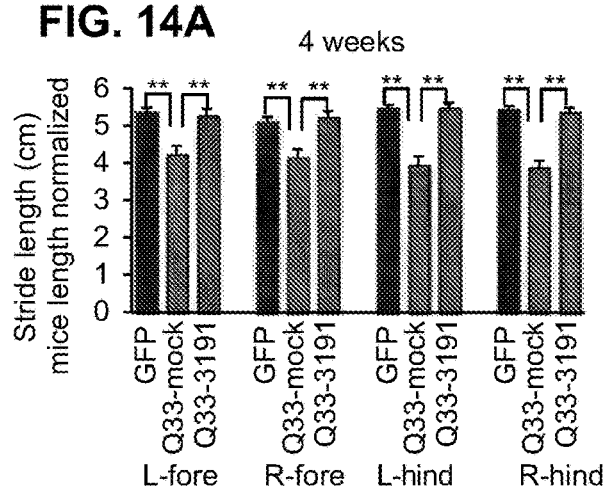
FIGS. 14A-14F demonstrate the video-assisted computerized treadmill for the gait analysis of mice injected with AAV.
Figure 14B:
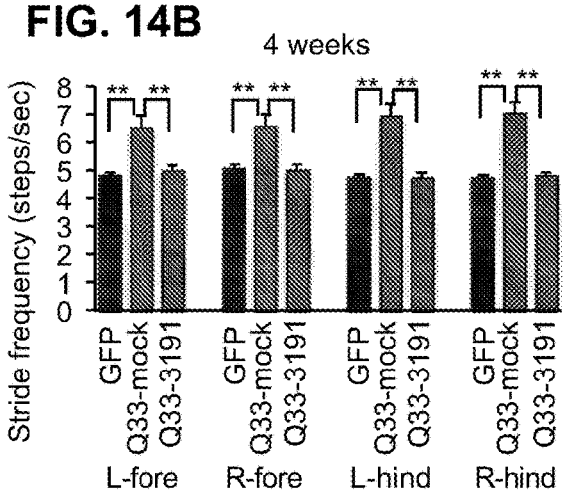
Figure 14C:
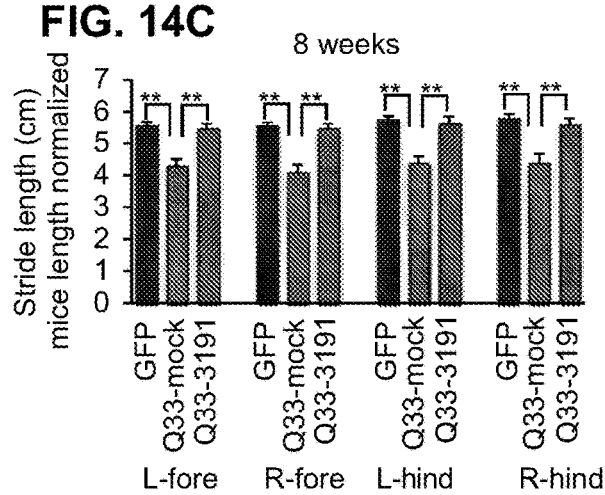
Figure 14D:
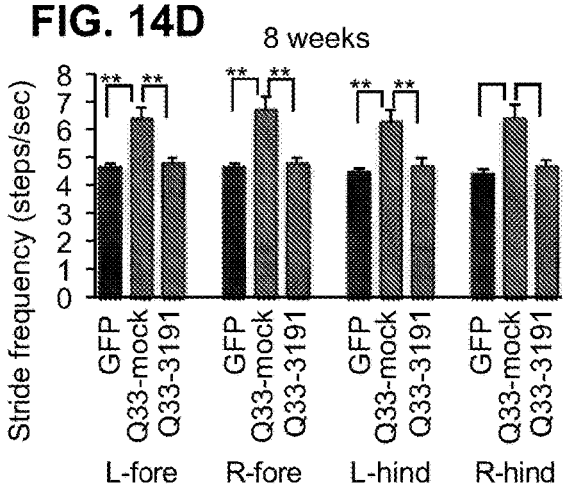
Figure 14E:
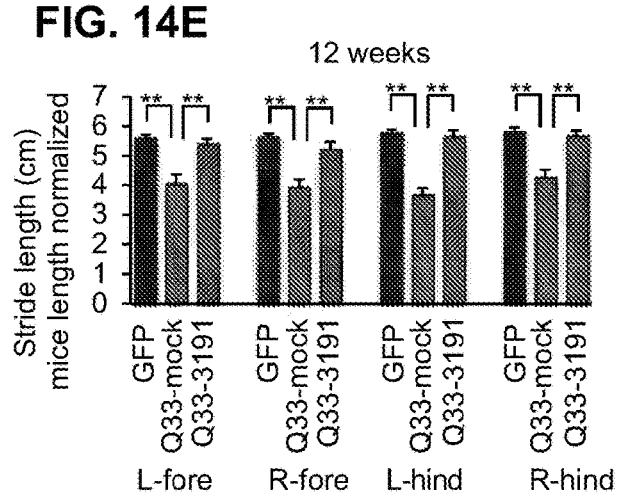
Figure 14F:
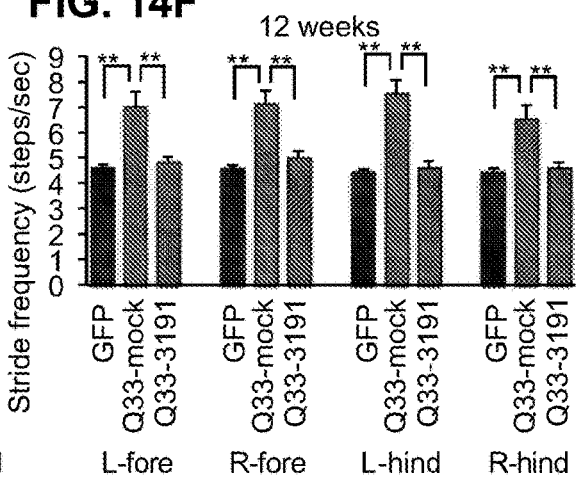
Figures 15A, 15B, 15C, 15D, 15E, 15F:
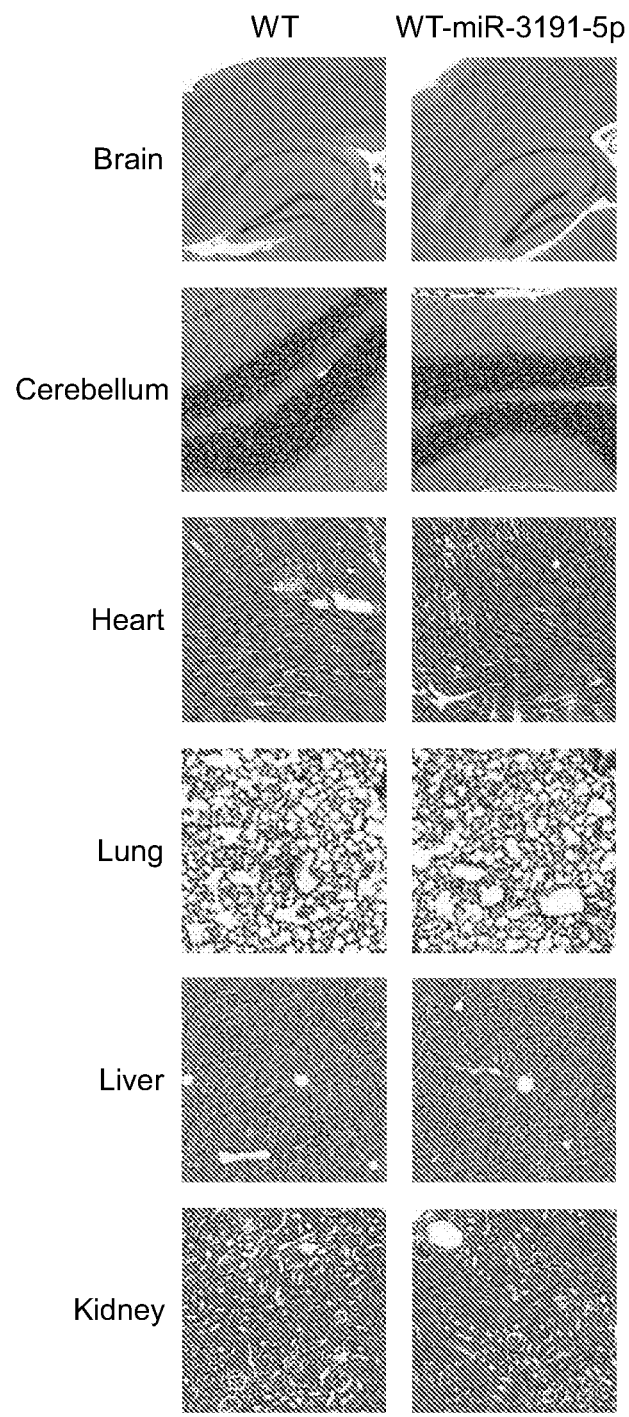
FIGS. 15A-15F demonstrate a histopathological examination of the brain, cerebellum, heart, lung, liver, and kidney of WT mice treated with AAV-miR-3191-5p.

Next, to address the therapeutic effects of the reduction of IRES-driven translation of α1ACT$_{SCA6}$ by miR-3191-5p on our SCA6 mouse model, we constructed an AAV vector that allowed for the simultaneous expression of GFP and either miR-3191-5p (AAV-miR-3191-5p) or a nonspecific miRNA, miR-mock (AAV-miR-mock). We then co-injected AAV-α1ACT-Q33 with either AAV-miR-3191-5p or AAV-miR-mock into the right lateral ventricle of neonatal WT mice of C57/BL6J at post-natal day 1. Western blot analysis revealed the persistent and widespread expression of α1ACT-Q33-FLAG or GFP in the brain and cerebellum of mice co-injected with AAV-α1ACT-Q33 and either AAV-miR-mock (WT-Q33-miR-mock mice) or AAV-miR-3191-5p (WT-Q33-miR-3191-5p mice) for at least 12 weeks and the significantly decreased α1ACT-Q33-FLAG protein levels in the brain and cerebellum of WT-Q33-miR-3191-5p mice as compared to WT-Q33-miR-mock mice (FIG. 13). WT-Q33-miR-3191-5p mice showed the same expression levels of mRNA transcribed from the transgenes delivered by AAV-α1ACT-Q33 in the cerebellum as compared to WT-Q33-miR-mock mice (FIG. 13). Immunohistochemical examination of mouse cerebellum showed normal thickness of the molecular layer, density of dendritic tree and number of Purkinje cells in the cerebellum of WT-Q33-miR-3191-5p mice (FIG. 4A to FIG. 4D) compared with WT-Q33-miR-mock mice. Although the treatment with AAV-miR-3191-5p did not affect the clinical symptoms of body weight in WT-Q33-miR-3191-5p mice compared to WT-Q33-miR-mock mice (FIG. 4E), we found that the α1ACT$_{SCA6}$-associated disease phenotypes in WT-Q33-miR-3191-5p mice were prevented, assessed by rotarod (FIG. 4F), open field assay (FIG. 4G), and a video-assisted computerized treadmill for gait analysis (FIG. 14A to FIG. 14F). We also monitored WT mice injected with AAV-miR-3191-5p at postnatal day 1 to examine the adverse off-target effects of the treatment with AAV-miR-3191-5p. We found no obvious adverse effects in mouse behavior or morphological anomalies in the brain, cerebellum, heart, lung, liver, and kidney of the WT mice injected with AAV-miR-3191-5p for at least 12 weeks (FIG. 15).

In summary, we discovered that miR-3191-5p directly acts on the CACNA1A IRES to regulate the translation of α1ACT, which requires the presence of Ago4. We have also demonstrated that miR-3191-5p bound to Ago4 preferentially inhibits the translational initiation of α1ACT by eukaryotic initiation factors, eIF4AII and eIF4GII, which enhance α1ACT translation. We further showed that the inhibition of the CACNA1A IRES-driven α1ACT$_{SCA6}$ expression by the AAV vector-mediated delivery of miR-3191-5p has a therapeutic effect on the α1ACT$_{SCA6}$-induced SCA6 phenotypes in our model mouse.

Our results are the first to point to a specific role of a natural miRNA in repressing translation by the direct interaction with a site within cellular IRES (16, 27, 28). There are four members of the RNA-induced silencing complex-related Ago protein family in human, Ago1, Ago2, Ago3, and Ago4 (22). Very little is known about Ago4, although the absence of a catalytic domain suggests that it might have a distinct role in gene silencing compared with Ago2 (29-34). Our findings that Ago4 appears to selectively interact with a miRNA and the CACNA1A IRES to repress translation may suggest it has a specific role for mRNA-sparing translational repression via the miRISC, possibly even selectively for translational repression of IRESs. Finally, because therapy targeting IRES activity has been a mainstay of anti-viral therapy and not been employed for genetic disease (35-37), this work will prepare us for the development of therapies using a novel strategy by the selective suppression of IRES-driven pathogenic gene products based on delivery of disease-specific miRNAs in future.

This example demonstrates a novel miRNA-mediated therapeutic approach for spinocerebellar ataxia type 6 via the selective translational block of second cistron in CACNA1A gene.

Example 2

This example provides a description of the materials and methods used in the experiments of Example 8.

Construction of DNA Plasmids

We used pcDNA3 vectors expressing CACNA1A-encoded FLAG-tagged peptides (α1A-FLAG and α1ACT-FLAG) and a bicistronic IRES reporter vector or control vector as described previously (9).

To obtain mutated transgenes that are resistant to the binding of miR-3191-5p (CACNA1A IRESmut vectors), we performed C>G and G>C substitutions within the predicted miR-3191-5p binding site. We also performed C>G and G>C substitutions within the complementary binding site of the sequence targeted by miR-3191-5p to maintain the structure of CACNA1A IRESmut same as that of the original (FIG. 1D, FIG. 8A and FIG. 8B). Briefly, we amplified the predicted binding site of miR-3191-5p using primers miR mut forward: 5'-ATGTCTCCGCCCCTGGGTCTccc-cAAcAAcTcTggccCCAGAGTGGCTTACAAGCG-3' (SEQ ID NO: 182) and miR mut reverse: 5'-CGCTTGTAAGCCACTCTGGggccAgAgTTgTTggg-gAGACCCAGGGGCGGAGACAT-3' (SEQ ID NO: 183), the complementary binding site of the sequence targeted by miR-3191-5p using primers anti-miR mut forward: 5'-ACT-GAGCACAATAACTTggccAggTTgTTgg AGGCCCT-CATGCTTCTC-3' (SEQ ID NO: 184) and anti-miR mut reverse: 5'-GAGAAGCATGAGGGCCTccAAcAAccTggc-cAAGTTATTGTGCTCAGT-3' (SEQ ID NO: 185). Then we annealed PCR products using primers anti-miR mut forward and miR mut reverse and inserted the annealed PCR products into the BlpI sites of pcDNA3 vectors expressing CACNA1A-encoded FLAG-tagged peptides and the EcoRI and NcoI sites of a bicistronic IRES reporter vector.

We also prepared the truncated transgenes of CACNA1A second cistron that lacked the sequence of 5' up-stream from CACNA1A IRES (IRESstopmut-α1ACT: FIG. 10A and FIG. 10B). Briefly, the sequence of 4962 to 7757 nt of full-length CACNA1A (NM_001127222.1, NP_001120694.1), correspondent to the sequence of CACNA1A IRES and α1ACT open reading frame, was amplified using primers IRESstopmut-α1ACT forward: 5'ATCAGGATCCGCCCTCAACACCATCGTGC-3' (SEQ ID NO: 186) and IRESstopmut-α1ACT reverse: 5'-GAATCTAGATTACTTGTCATCG-3' (SEQ ID NO: 187) from pcDNA3 vectors expressing CACNA1A-encoded FLAG-tagged peptides. The PCR product was inserted into the BamHI and XbaI sites of pcDNA3 vectors. We also modified the sequence of 5013 to 5015 nt from "TAT" to "TAG" of stop codon.

pDEST-GFP-Ago4 is a kind gift from E. Chan (Addgene plasmid #21536) (38). pcDNA3-HA-eIF4GI and pcDNA3-HA-eIF4GII are kind gifts from N. Sonenberg (McGill University, Canada) (39). M. Bushell (Medical Research Council, UK) kindly provided us with the plasmid expressing human eIF4AI and eIF4AII (13). pcDNA3.1-HisXpress vector was a kind gift from T. Cooper (Baylor College of Medicine). From the plasmids expressing human eIF4AI and eIF4AII, we amplified human eIF4AI and eIF4AII cDNA using primers eIF4AI-PCR forward: 5'-ATCAG-GATCCATGTCTGCGAGCCAGGAT-3' (SEQ ID NO: 188); eIF4AI-PCR reverse: 5'-ATCAGGGCCCAGGTCAGCAACATTGAGG-3' (SEQ ID NO: 189); and eIF4AII-PCR forward: 5'-ATCAGGATC-CATGTCTGGTGGCTCCGCG-3' (SEQ ID NO: 190); eIF4AII-PCR reverse: ATCAGGGCCCT-TAAATAAGGTCAGCCAC-3' (SEQ ID NO: 191), respectively. Then we inserted PCR products into BamHI and ApaI digested pcDNA3.1-HisXpress vectors to obtain pcDNA3.1-HisXpress-eIF4AI or -eIF4AII. We used the original either pcDNA3.1/HisC or pcDNA3-HA vectors lacking the insertions in the multiple cloning sites as control vectors.

Co-Transfection of DNA Plasmids with Either Synthetic miRNA or siRNA into Cultured Cells HEK293 cells were cultured in DMEM supplemented with 10% FBS. All siRNAs and miRNAs were purchased from Life Technologies. ID numbers are shown as follows: Ago1 (s25500); Ago2 (s25931); Ago3 (s46947); Ago4 (s46949); eIF4AII (s4570); eIF4GII (s16519); a siRNA negative control (#12935-300); miR-711 (MC15715); miR-3191-5p (MC23769); miR-4786-3p (MC21295); and a miRNA negative control (#4464059). We plated HEK293 cells onto six-well dishes and co-transfected each dish with 1.0 μg of the vector expressing the following: a bicistronic IRES reporter, control reporter, and α1A-FLAG and α1ACT-FLAG; 0.5 μg of the vector expressing the following: eIF4AI, eIF4AII, eIF4GI, and eIF4GII; and either 20 nM synthetic miRNA or 20 nM siRNA molecules. We used Lipofectamine 2000 (Life Technologies) as a transfection reagent in all cases. Neither the siRNA negative control nor the miRNA negative control matched any human mRNA. The transfected cells were cultured for 48 hrs before being processed for RNA and protein analysis.

Luciferase Assay

HEK293 cells were plated onto six-well plates and co-transfected with a bicistronic IRES reporter vector or control vector. 48 hrs after co-transfection, luciferase activities were determined using the Dual-Luciferase Assay System (Promega) as manufacturer's instructions. The activities of Firefly and Renilla luciferase in lysates prepared from transfected cells using the Dual-Luciferase Assay System were measured by using a Wallac 1420 VICTOR 3 V luminometer with a 1 sec integration time (Perkin Elmer, Waltham, Mass.).

Protein Expression Analysis

We did western blot analysis as previously described (9, 40). We used the following primary antibodies: FLAG-specific antibody (1:5,000, A8592 and 1:5,000, F1804; Sigma-Aldrich); Ago1-specific antibody (1:2,000, 9388S; Cell Signaling Technology); Ago2-specific antibody (1:2,000, SAB4200085; Sigma-Aldrich); Ago3-specific antibody (1:2,000, 5054S; Cell Signaling Technology); Ago4-specific antibody (1:2,000, 6913S; Cell Signaling Technology); eIF4AII-specific antibody (1:2,000, ab31218; Abcam); eIF4GII-specific antibody (1:1,000, sc-100732; Santa Cruz Biotechnology); GFP-specific antibody (1:2,000, M048-3; MBL); GAPDH-specific antibody (1:5,000, AM4300; Life Technologies).

Quantitative Real-Time PCR

The total RNA was extracted from HEK293 cells and the brain and cerebellum of mice using the miRNeasy Mini Kit (Qiagen) and reverse transcribed using the Superscript VILO (Life Technologies) for mRNA and NCode VILO (Life Technologies) for miRNA. The complementary DNAs were then used for real time PCR using the iQ SYBR Green Supermix (Bio-Rad Laboratories). We did the amplification, detection, and data analysis using a Bio-Rad iCycler system (Bio-Rad Laboratories). The crossing threshold values for the mRNAs of the individual genes were normalized to beta-actin. The crossing threshold values for the miRNA of the individual genes were normalized to the U6 small nuclear RNA. Changes in the expression of mRNA and miRNA were expressed as a fold change relative to the control. We used the following primers in this study. The sequences of the hsa-CACNA1A primers were: forward, 5'-GTCTGGGGAAGAAGTGTCCG-3' (SEQ ID NO: 192); reverse, 5'-GCTCCTCCCTTGGCAATCTT-3' (SEQ ID NO: 193). These hsa-CACNA1A primers discriminated between the human CACNA1A mRNA and the mouse CACNA1A mRNA. The sequences of the luciferase reporter primers were: forward, 5'-TTTACATGGTAACGCGGCCT-3' (SEQ ID NO: 194); reverse, 5'-GGTCTGGTATAATA-CACCGCGC-3' (SEQ ID NO: 195). The sequences of the hsa-beta-actin primers were: forward, 5'-GCGG-GAAATCGTGCGTGACATT-3' (SEQ ID NO: 196); reverse, 5'-GATGGAGTTGAAGGTAGTTTCGTG-3' (SEQ ID NO: 197). The sequences of the mmu-beta-actin primers were: forward, 5'-GCTACAGCTTCACCACCACA-3' (SEQ ID NO: 198); reverse, 5'-TCTCCAGGGAG-GAAGAGGAT-3' (SEQ ID NO: 199). The sequences of the miR-3191-5p primers were: forward, 5'-GCTCTCTGGCCGTCTAC-3' (SEQ ID NO: 200); reverse, 5'-GTCCAGTTTTTTTTTTTTTTGGAAG-3' (SEQ ID NO: 201). The sequences of the U6 small nuclear RNA primers were: forward, 5'-CTTCGGCAGCA-CATATACTAAA-3' (SEQ ID NO: 202); reverse, 5'-AAAATATGGAACGCTTCACG-3' (SEQ ID NO: 203). We designed the miR-3191-5p primers using a bioinformatics program (41).

Immunoprecipitation.

We plated HEK293 cells onto 100 mm dishes and co-transfected each dish with 3.0 of the vector expressing eIF4AII and eIF4GII. 48 hrs after transfection, we harvested HEK293 cells for immunoprecipitation using eIF4AII-specific antibody (5 μg per sample, ab31218; Abcam), eIF4GII-specific antibody (5 μg per sample, sc-100732; Santa Cruz Biotechnology), and Dynabeads™ Protein G Immunoprecipitation Kit (Life Technologies) according to the manufacturer's suggested protocols. An rabbit immunoglobulin G (5 μg per sample, PP64B; Millipore) and mouse immunoglobulin G (5 μg per sample, CS200621; Millipore) were used as controls.

Immunoprecipitation-Coupled qRT-PCR.

We plated HEK293 cells onto 100 mm dishes and co-transfected each dish with 2.0 μg of the vector expressing the following: full-length CACNA1A-Q33-encoded FLAG-tagged peptides, GFP-miR-3191-5p (SC401396; OriGene), GFP-Ago4, bicistronic IRES reporter, control reporter, eIF4AII, eIF4GII, or the truncated transgenes of CACNA1A second cistron lacking the sequence of 5' up-stream from CACNA1A IRES (IRESstopmut-α1ACT). We used the original either pcDNA3.1/HisC or pcDNA3-HA vectors lacking the insertions in the multiple cloning sites as control vectors. 48 hrs after transfection, we harvested HEK293 cells for co-immunoprecipitation using Ago4-specific antibody (5 µg per sample, 6913S; Cell Signaling Technology), eIF4AII-specific antibody (5 µg per sample, ab31218; Abcam), eIF4GII-specific antibody (5 µg per sample, sc-100732; Santa Cruz Biotechnology), and Magna RIP™ RNA-Binding Protein Immunoprecipitation Kit (Millipore) according to the manufacturer's suggested protocols. An rabbit immunoglobulin G (5 µg per sample, PP64B; Millipore) and mouse immunoglobulin G (5 µg per sample, CS200621; Millipore), supplied by the manufacturer, were used as controls. Immunoprecipitated RNA was converted to cDNA using Superscript VILO (Life Technologies) for mRNA and NCode VILO (Life Technologies) for miRNA and analyzed by qRT-PCR for the differential expression of α1A-Q33 mRNA and IRESstopmut-α1ACT mRNA using the following primers: forward, 5'-GTCTGGG-GAAGAAGTGTCCG-3' (SEQ ID NO: 192); reverse, 5'-GCTCCTCCCTTGGCAATCTT-3' (SEQ ID NO: 193), miR-3191-5p: forward, 5'-GCTCTCTGGCCGTCTAC-3' (SEQ ID NO: 200); reverse, 5'-GTCCAGTTTTTTTTTTTTTTGGAAG-3' (SEQ ID NO: 201), a bicistronic IRES reporter vector: forward, 5'-TGCTGACTGTTTTCCAGTGC-3' (SEQ ID NO: 204); reverse, 5'-AAGGAGCCGATGATGATGAG-3' (SEQ ID NO: 205), and control reporter vector: forward, 5'-TTTA-CATGGTAACGCGGCCT-3' (SEQ ID NO: 194); reverse, 5'-GGTCTGGTATAATACACCGCGC-3' (SEQ ID NO: 195).

Development of the Adeno-Associated Virus (AAV) Vectors Expressing FLAG Tagged α1ACT Under the Control of CACNA1A IRES or Simultaneous Expression of miRNA and GFP.

The AAV vector plasmids contained an expression cassette consisting of a human cytomegalovirus immediate-early promoter, followed by a target DNA or miR, and a simian virus 40 polyadenylation signal sequence between the inverted terminal repeats of the AAV3 genome. The AAV9 vp cDNA was synthesized as previously described with the substitution of thymidine for adenine 1337, which introduced an amino acid change from tyrosine to phenylalanine at position 446 (42). Recombinant AAV vectors were produced by transient transfection of HEK293 cells using the vector plasmid, an AAV3 rep and AAV9 vp expression plasmid, and the adenoviral helper plasmid pHelper (Agilent Technologies, Santa Clara, Calif.). The recombinant viruses were purified by isolation from two sequential continuous CsCl gradients, and the viral titers were determined by qRT-PCR. The viral vectors used for expression of α1ACT with normal repeat size (AAV-α1ACT-Q11) and mutant repeat size (AAV-α1ACT-Q33) contained the truncated transgenes of CACNA1A second cistron that lacked the sequence of 5' up-stream from CACNA1A IRES (IRESstopmut-α1ACT) (FIG. 11A). AAV-GFP contained the Aequorea coerulescens GFP. The sequences of miR-3191-5p and miR-mock are as follows. miR-3191-5p: 5'GGGGTCACCTCTCTGGCCGTCTACCTTC-CACACTGACAAGGGCCGTGGGGACGTA GCTGGCCAGACAGGTGACCCC-3' (SEQ ID NO: 181); miR-mock: 5'-GTATTGC GTCTGTACACT-CACCGTTTTGCCACTGACTGACGGTGAGTGCAG ACGCAATA-3' (SEQ ID NO: 206).

Injection of AAV into the Ventricle of Neonatal Wild-Type (WT) Mice.

C57/BL6J mice were purchased from Jackson Laboratory and maintained in our breeding colony. At post-natal day 1, neonatal mice were individually anesthetized on ice, and a total of $10^9$ vector genomes in 3-5 µl of AAV solution was injected into the right lateral ventricle with a Hamilton syringe 10 ul, 32G (Hamilton Company). The viral solution contained 0.04% trypan blue (Sigma-Aldrich) to help determine if the ventricles were indeed injected. Only those neonatal WT mice in which the lateral ventricles were filled with viral solution were analyzed. 6 male and 6 female mice were enrolled into each group: two groups of WT-GFP mice; WT-α1ACT-Q11 mice; WT-α1ACT-Q33 mice; WT-Q33-mock mice; and WT-Q33-miR-3191-5p mice. All animal experiments were approved and carried out in accordance with the regulations and guidelines for the care and use of experimental animals at the Institutional Animal Care and Use Committee of the University of Chicago.

The Neurological and Behavioral Assessment of the WT Mice Injected with AAV.

We examined the neurological and behavioral assessments of all mice at 4, 8, and 12 weeks of age.

Rotarod-task. We analyzed rotarod task of mice using an Economex Rotarod (Colombus Instruments, Colombus, Ohio) with accelerating mode (4-40 rpm, acceleration with 0.1 rpm per 0.8 sec). We performed three consecutive trials and recorded the longest duration on the rod for each mouse.

Open field assay. We examined open field assay using Mouse Open Field Arena and 48 Cannel IR Controller for Open Field Activity (ENV-510 and ENV-520; Med Associates, Inc., St Albans City, Vt.). Briefly, mice were placed in the center of open field area and their movements were monitored through the side-mounted photobeams for 30 min. We analyzed multiple parameters using Activity Monitor software (Med Associates, Inc., St Albans City, Vt.) and adopted total distance traveled to assess the activity of each mouse.

Digigait analysis. We also examined a video-assisted computerized treadmill for mouse gait analysis using a Digigait with Digigait software (Mouse Specifics, Framingham, Mass.). All mice were tested at the speed of 25 cm/sec. Stance length was normalized to mouse body length.

Immunohistochemistry, Immunofluorescence, and Histopathology

Immunohistochemistry was performed as previously reported except as modified below (43). Briefly, paraffin-embedded sections of perfused brains were de-waxed and rehydrated, then steamed for 20 min in antigen retrieval solution (Reveal; Biocare Medical, Walnut Creek, Calif.). Sections were blocked and exposed to primary antibody for 12 hrs at 4° C. After washing, fluorescent secondary antibody in PBS-T (phosphate buffered saline and 0.05% Tween-20) was added for 1 hr at room temperature. Confocal fluorescence images were captured with a Leica TCS SP2 laser scanning confocal microscope (Leica Microsystems, Inc., Buffalo Grove, Ill.). We used NIH Image J software to quantify the percentage of specific expression of antibody in each sample. The molecular layer thickness and density of Purkinje dendritic trees were calculated as previously described (9, 44). Purkinje cells selected for the measurements spanned the molecular layer were well-stained and were not obscured by adjacent cells. The dendritic trees of the captured Purkinje cell image and the area enclosed were outlined and measured using NIH Image J software. 50-100 Purkinje cells were analyzed in each sample to calculate the mean of the density of Purkinje dendritic trees. To assess the number of Purkinje cells in cerebellum, we calculated the number of Purkinje cells in the entire area and expressed the results as the number per 250 µm. We used the following primary antibodies: FLAG-specific antibody (1:200, F1804; Sigma-Aldrich); GFP-specific antibody (1:200, M048-3; MBL); calbindin-specific antibody (1: 200, CB38a; Swant). Goat AlexaFluor 488-conjugated anti-rabbit and goat AlexaFluor 594-conjugated anti-mouse IgG antibodies (Lifetechnologies) were used for secondary fluorescence detection. For the tissue sections stained with Hematoxilyn and eosin staining, digital image files were created with a 3D Histech Pannoramic Scan whole slide scanner (Perkin Elmer, Waltham, Mass.) with a Stingray F146C color camera (Allied Vision Technologies, Stadtroda, Germany). Individual images were created with the 3D Histech Pannoramic Viewer software (Perkin Elmer, Waltham, Mass.).

Statistical Analysis

All data represent 3 biological repeats unless stated otherwise. Values represent mean±standard error of the mean (S.E.M.). Differences between experimental groups were compared by Student's t-test (two tailed), or two-way ANOVA with Bonferroni post-test when multiple comparisons were made. Statistical significance in figures: *P<0.05, P<0.01, *P<0.001, n.s.: not significant.

Example 3

This example demonstrates selectively turning off disease genes without disrupting other processes, a growing goal of genetic research. In this example, we work with a gene that expresses two proteins, a calcium channel, necessary for life, and a regulatory protein, α1ACT, which, when mutated, causes a form of ataxia called SCA6. We figured out how to block expression of the disease protein without affecting the calcium channel using a small sequence of RNA called miRNA. We then used a viral vector to deliver this miRNA to mice engineered to develop a severe form of SCA6 and successfully prevented the disease.

Spinocerebellar ataxia type 6 (SCA6) is a dominantly inherited neurodegenerative disease characterized by slowly progressive ataxia and Purkinje cell degeneration. SCA6 is caused by a polyglutamine repeat expansion within a second CACNA1A gene product, α1ACT. α1ACT expression is under the control of an internal ribosomal entry site (IRES) present within the CACNA1A coding region. Whereas SCA6 allele knock-in mice show indistinguishable phenotypes from wild-type littermates, expression of SCA6-associated α1ACT (α1ACTSCA6) driven by a Purkinje cell-specific promoter in mice produces slowly progressive ataxia and cerebellar atrophy. We developed an early-onset SCA6 mouse model using an adeno-associated virus (AAV)-based gene delivery system to ectopically express CACNA1A IRES-driven α1ACTSCA6 to test the potential of CACNA1A IRES-targeting therapies. Mice expressing AAV9-mediated CACNA1A IRES-driven α1ACTSCA6 exhibited early-onset ataxia, motor deficits, and Purkinje cell degeneration. We identified miR-3191-5p as a microRNA (miRNA) that targeted CACNA1A IRES and preferentially inhibited the CACNA1A IRES-driven translation of α1ACT in an Argonaute 4 (Ago4)-dependent manner. We found that eukaryotic initiation factors (eIFs), eIF4AII and eIF4GII, interacted with the CACNA1A IRES to enhance α1ACT translation. Ago4-bound miR-3191-5p blocked the interaction of eIF4AII and eIF4GII with the CACNA1A IRES, attenuating IRES-driven α1ACT translation. Furthermore, AAV9-mediated delivery of miR-3191-5p protected mice from the ataxia, motor deficits, and Purkinje cell degeneration caused by CACNA1A IRES-driven α1ACTSCA6. We have established proof of principle that viral delivery of an miRNA can rescue a disease phenotype through modulation of cellular IRES activity in a mouse model.

Introduction

Spinocerebellar ataxias (SCAs) are a genetically heterogeneous group of dominantly inherited neurodegenerative diseases characterized by progressive ataxia and Purkinje cell degeneration (1-3). To date, more than 30 SCAs have been characterized, each being associated with distinct genes and mutations and therefore requiring individual therapeutic approaches (2, 3). The lack of efficacious therapeutics and the large number of genetic events that result in SCAs have highlighted the need for effective preclinical models to identify and test "druggable" targets.

SCA type 6 (SCA6) is one of the most common forms of autosomal dominant SCAs, representing 10 to 20% of patients with dominantly inherited ataxia. It has an incidence of about 5/100,000 persons (2-8). Patients with SCA6 develop slowly progressive cerebellar ataxia with extensive selective Purkinje cell degeneration, usually beginning at 40 to 50 years of age (2-8). SCA6 is caused by an expanded CAG repeat in the CACNA1A gene, which results in an expanded polyglutamine (polyQ) tract. Previous studies unexpectedly found that the expanded polyQ tract does not affect the function or kinetics of the α1A (Cav2.1, P/Q-type) voltage-gated Ca2+ channel subunit, a gene product of the full-length CACNA1A gene (9, 10). Additionally, SCA6 allele knock-in mice were indistinguishable from wild-type littermates, even in old age (9, 10).

We recently discovered that the CACNA1A gene is bicistronic, that is, it encodes both the full-length α1A subunit and a newly recognized transcription factor, α1ACT, consisting of 547 amino acids of the C terminus encoded within a separate open reading frame (ORF) of the same mRNA. The second cistron is translated from a newly identified internal ribosomal entry site (IRES) upstream of the second ORF. We have also characterized the cellular physiological and pathological properties of both wild-type α1ACT and an expanded polyQ tract containing α1ACT in vivo, showing that the expanded polyQ tract in α1ACT results in the SCA6 phenotype. Additionally, we showed that elimination of the portion of the IRES sequence from the human mRNA encoding SCA6-associated α1A selectively eliminated the expression of the SCA6-associated α1ACT (α1ACTSCA6) fragment and was protective in a cell culture model of α1ACTSCA6 toxicity (11). Because the complete silencing of CACNA1A gene expression would be lethal (11, 12), a more suitable therapeutic approach for SCA6 would be to selectively eliminate expression of α1ACT while sparing α1A expression. We reasoned that modulating the expression of microRNAs (miRNAs) targeting the CACNA1A IRES could offer a new therapeutic approach for treating SCA6 through regulation of IRES-dependent α1ACTSCA6 translation. On the basis of this hypothesis, we developed a mouse model in which α1ACTSCA6 was expressed in a CACNA1A IRES-dependent manner.

Results

Somatic Gene Transfer of CACNA1A IRES-Driven α1ACTSCA6 causes Purkinje Cell Degeneration in Mice We established an in vivo adeno-associated virus type 9 (AAV9) delivery system using the constructs of α1ACT transgenes tagged with a C-terminal FLAG epitope, expressed under the control of CACNA1A IRES (IRES-α1ACT-Q11 and IRES-α1ACT-Q33, FIG. 24A; AAV9-α1ACT-Q11 and AAV9-α1ACT-Q33, FIG. 24B). We also prepared a control AAV9 vector expressing green fluorescent protein (GFP) (AAV9-GFP). A viral load of 1010 vector genomes (vg) of each of these constructs was directly injected into the right lateral ventricle of neonatal wild-type C57/BL6J mice at postnatal day 1. In vivo delivery of AAV9 by intraventricular injection resulted in more than 75% of Purkinje cells being transduced with the AAV9 vector (FIG. 24C and FIG. 24D). Four weeks after AAV9 vector injection, we sacrificed the mice and found widespread expression of α1ACT-Q11-FLAG or α1ACT-Q33-FLAG that was predominantly observed in the cerebral cortex and cerebellum of wild-type mice injected with AAV9-α1ACT-Q11 (AAV9-α1ACT-Q11 mice) or AAV9-α1ACT-Q33 (AAV9-α1ACT-Q33 mice) (FIG. 16A, FIG. 16B). Quantitative real-time polymerase chain reaction (qRT-PCR) of total RNA from the cerebellum of AAV9-injected mice revealed that α1ACT mRNA in the cerebellum of AAV9-α1ACT-Q11 and AAV9-α1ACT-Q33 mice showed a greater than 2.5-fold up-regulation compared to mouse endogenous CACNA1A mRNA in the cerebellum of wild-type mice injected with AAV9-GFP (AAV9-GFP mice). Expression of IRES-α1ACT-Q11 mRNA in AAV9-α1ACT-Q11 mice was comparable to that of IRES-α1ACT-Q33 mRNA in AAV9-α1ACT-Q33 mice (FIG. 16C). CACNA1A IRES-driven α1ACT protein expression in the cerebellum was also comparable between AAV9-α1ACT-Q11 and AAV9-α1ACT-Q33 mice (FIG. 16D).

Figure 25A:
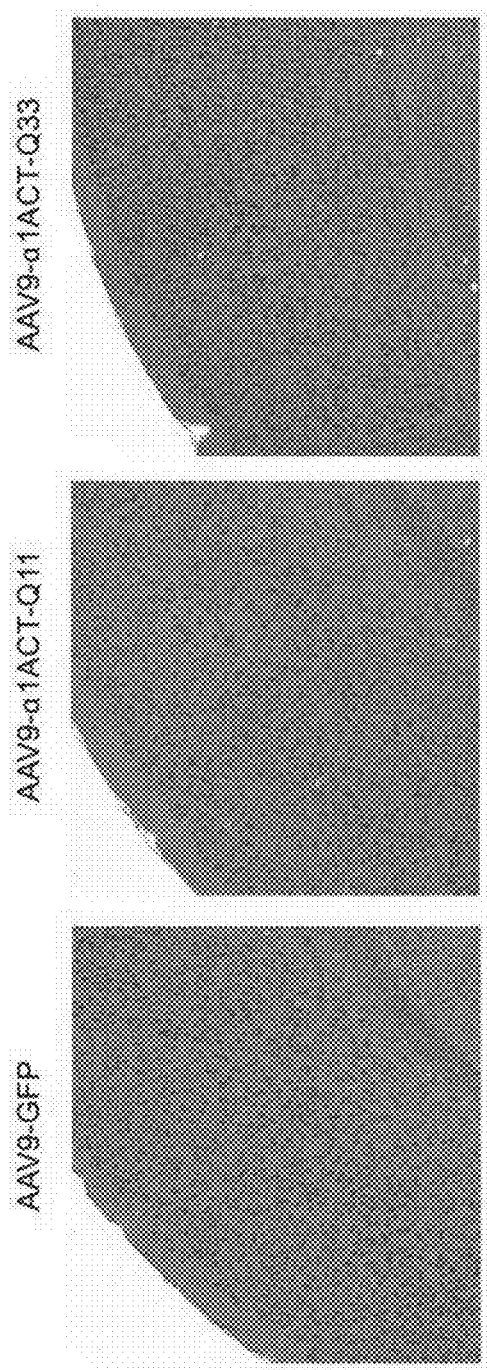
FIGS. 25A-25B provide data demonstrating a histopathological examination of the AAV9-injected mouse cerebral cortex and hippocampus.
Figure 25B:
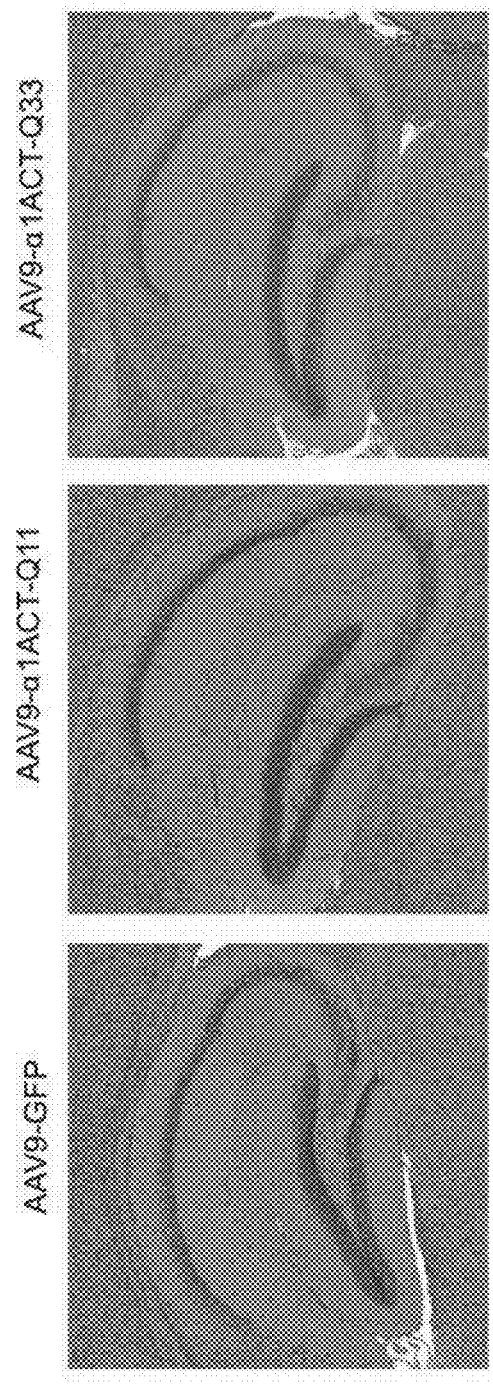
Figure 26A:
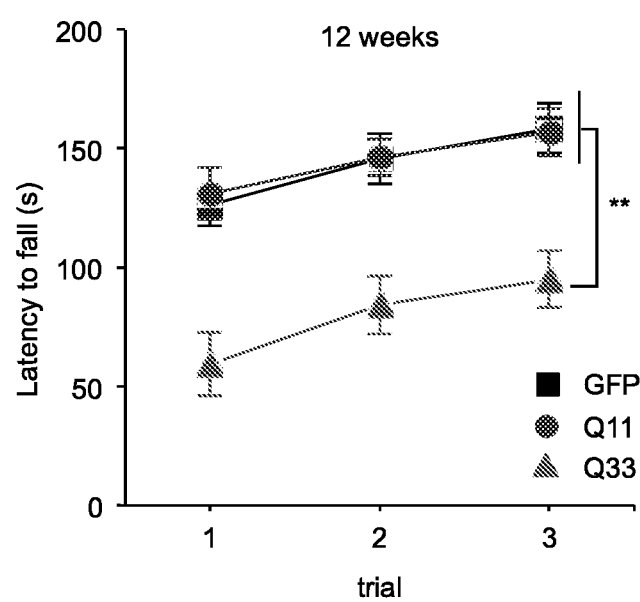
Figure 26B:
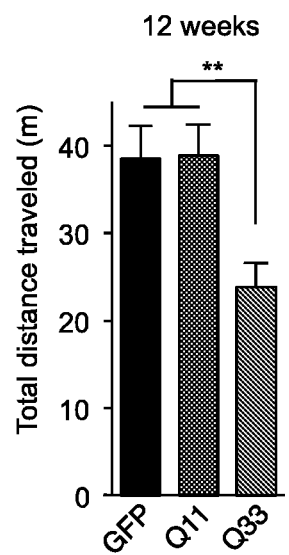
Figures 27A, 27B, 27C, 27D:
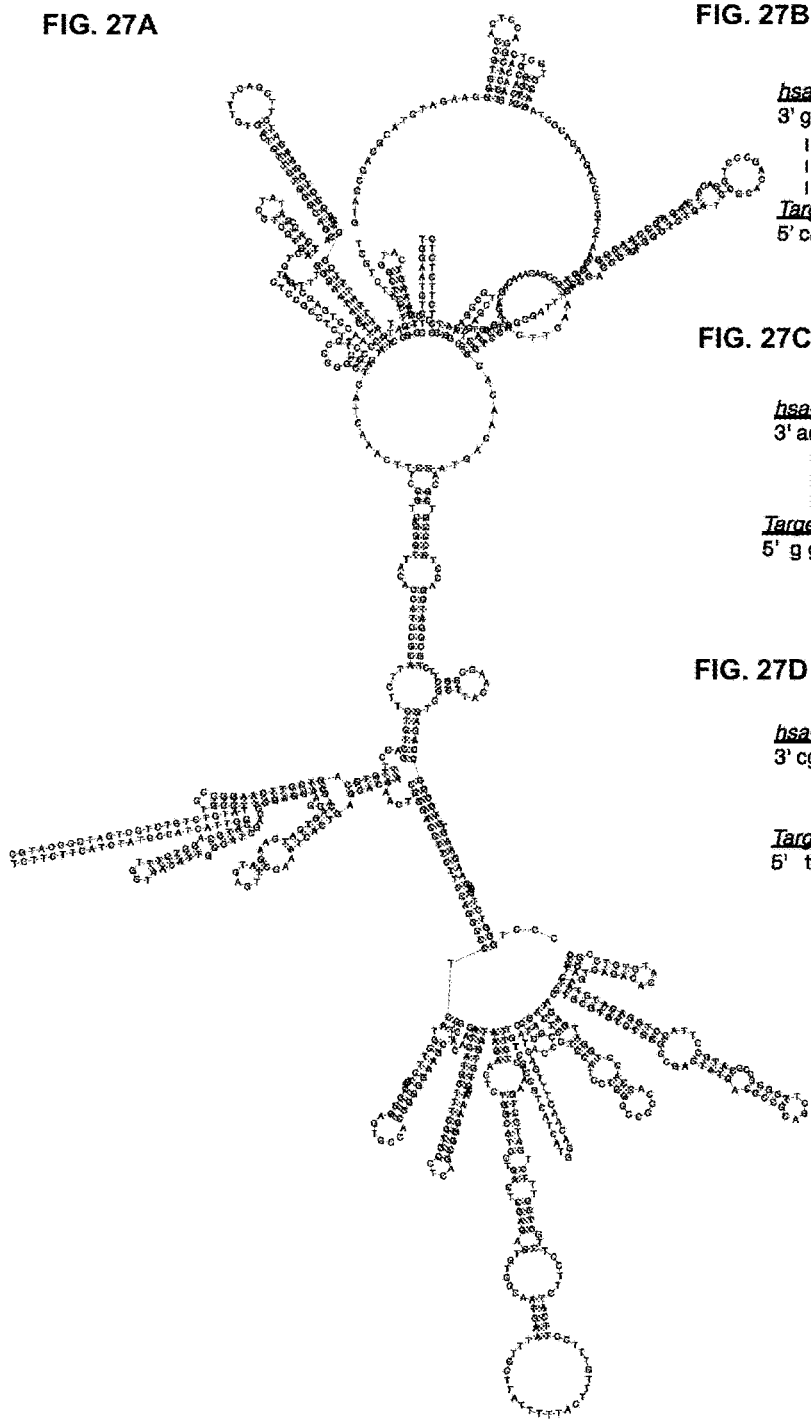
FIGS. 27A-27D demonstrate the stem-loop structure of CACNA1A IRES and the predicted binding sites of miR-711, miR-3191-5p, and miR-4786-3p.

We found that, compared with AAV9-α1ACT-Q11 mice, AAV9-α1ACT-Q33 mice showed a significant decrease in the molecular layer thickness (P<0.01) and the density of the Purkinje cell dendritic tree (P<0.01) (FIG. 16E-FIG. 16G). We also found that AAV9-α1ACT-Q33 caused a 50% loss of Purkinje cells in the cerebellum (FIG. 16H) but no obvious pathological changes in the cerebral cortex and hippocampus (FIG. 25A and FIG. 25B). These pathological features in the cerebellum of AAV9-α1ACT-Q33 mice resembled those of Purkinje cell degeneration in patients with SCA6 (13-15)

CACNA1A IRES-Driven α1ACTSCA6 Causes an Early-Onset Ataxia and Motor Deficits in Mice To assess the behavioral phenotype of AAV9-α1ACT-Q33 mice, we used a rotarod performance test, an open-field assay, and a gait stability assessment using a video-assisted computerized treadmill (DigiGait) for gait analysis. AAV9-α1ACT-Q33 mice grew at roughly the same rate and had a comparable body weight to AAV9-α1ACT-Q11 and AAV9-GFP mice (FIG. 17A). However, AAV9-α1ACT-Q33 mice showed defects in motor functions as assessed by the rotarod test (FIG. 17B), activity in the open-field assay (FIG. 17C), and gait stability by the gait analysis assay (FIG. 17D-FIG. 17E). AAV9-α1ACT-Q33 caused impaired performance on the accelerating rotarod test in mice beginning at 4 weeks of age (P<0.01) (FIG. 17B). Ambulatory distance in the open-field test was significantly shorter in AAV9-α1ACT-Q33 mice than in AAV9-α1ACT-Q11 and AAV9-GFP mice (P<0.01) (FIG. 17C). DigiGait analyses revealed that AAV9-α1ACT-Q33 mice exhibited shorter stride length (P<0.05) (FIG. 17D) and greater stride frequencies (P<0.05) (FIG. 17E) in all four limbs from 4 weeks of age, indicating early-onset instability during walking. AAV9-α1ACT-Q33 mice often showed weaving from side to side on a treadmill, whereas AAV9-α1ACT-Q11 and AAV9-GFP mice typically walked straight (movies S1 to S3). Furthermore, the deficit in behavioral phenotypes of AAV9-α1ACT-Q33 mice and continuous CACNA1A IRES-driven α1ACT expression in the cerebellum were observed over a long-term follow-up of 30 weeks (FIG. 26A to FIG. 26G). These findings indicate that AAV9-mediated somatic gene transfer of α1ACTSCA6 under the control of CACNA1A IRES caused severe ataxia in mice at much earlier ages and more reproducibly than the Purkinje cell-specific promoter-driven transgenic SCA6 mouse model we previously developed (11).

miR-3191-5p Inhibits the CACNA1A IRES-Driven Translation of α1ACT while Sparing α1A and CACNA1A mRNA Expression To develop a CACNA1A IRES-directed therapeutic approach for SCA6, we used an miRNA-mediated approach. miRNAs have been increasingly recognized to play a role in the regulation of gene expression, in many cases by both translational repression and mRNA destabilization (16, 17). To date, miRNAs have not been used to preferentially regulate the translation of disease genes driven by a cellular IRES. Although prevailing evidence has pointed to the role of natural miRNAs in gene silencing and translational repression through binding to 3' untranslated regions (UTRs), or rarely 5'UTR, of targeted mRNAs (16-21), predicted miRNA binding sites are found throughout the genome including in both coding and noncoding regions (22, 23).

We used the miRNA_Targets program (22) to predict that miRNAs-miR-711 (accession number, MIMAT0012734), miR-3191-5p (accession number, MIMAT0022732), and miR-4786-3p (accession number, MIMAT0019955)-bind to sequences within the stem-loop structure of CACNA1A IRES (FIG. 27A to FIG. 27D) (24). To examine the effects of these miRNAs on CACNA1A IRES-driven translation, we cotransfected these miRNAs with either a bicistronic reporter vector bearing CACNA1A IRES or a control vector into human embryonic kidney (HEK) 293 cells (FIG. 18A). Dual-luciferase assays revealed that miR-711, miR-3191-5p, and miR-4786-3p down-regulated CACNA1A IRES-driven luciferase activities compared to a negative control miRNA (FIG. 18B). We tested the effects of these miRNAs on CACNA1A-encoded C-terminal FLAG-tagged peptides (α1A-FLAG and α1ACT-FLAG) with the normal (Q11) or pathological (Q33) polyQ tract in transfected HEK293 cells. Although miR-711 and miR-4786-3p decreased full-length α1A-FLAG and α1ACT-FLAG expression, miR-3191-5p down-regulated α1ACT-FLAG expression but spared α1A-FLAG expression (FIG. 18C and FIG. 18D). This was the case with α1A-FLAG and α1ACT-FLAG in mice with the normal (Q11) or pathological (Q33) polyQ tract. qRT-PCR studies of total RNA showed that miR-711 and miR-786-3p decreased CACNA1A mRNA expression relative to a negative control miRNA, but miR-3191-5p did not affect either CACNA1A-Q11 or CACNA1A-Q33 mRNA expression (FIG. 18E and FIG. 18F). We also found that miR-3191-5p did not affect endogenous CACNA1A mRNA expression in HEK293 cells (FIG. 18G).

To determine whether miR-3191-5p interacts with regions within the CACNA1A mRNA other than the CACNA1A IRES, we prepared mutated CACNA1A IRES templates, resistant to the binding of miR-3191-5p (CACNA1A IRESmut) (FIG. 28A to FIG. 28C). CACNA1A IRESmut functioned normally both in the CACNA1A IRESmut dual-luciferase assays and in the α1A-FLAG- and α1ACT-FLAG-expressing HEK293 cells, but inhibition of expression by miR-3191-5p was prevented (FIG. 28D and FIG. 28E). These results suggest that miR-3191-5p interacts with CACNA1A IRES only through its predicted binding site and inhibits the CACNA1A IRES-driven translation of α1ACT while sparing α1A expression and CACNA1A mRNA expression.

Figure 19A:
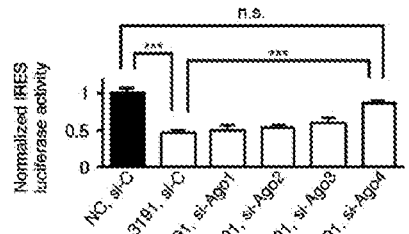
Figure 19B:
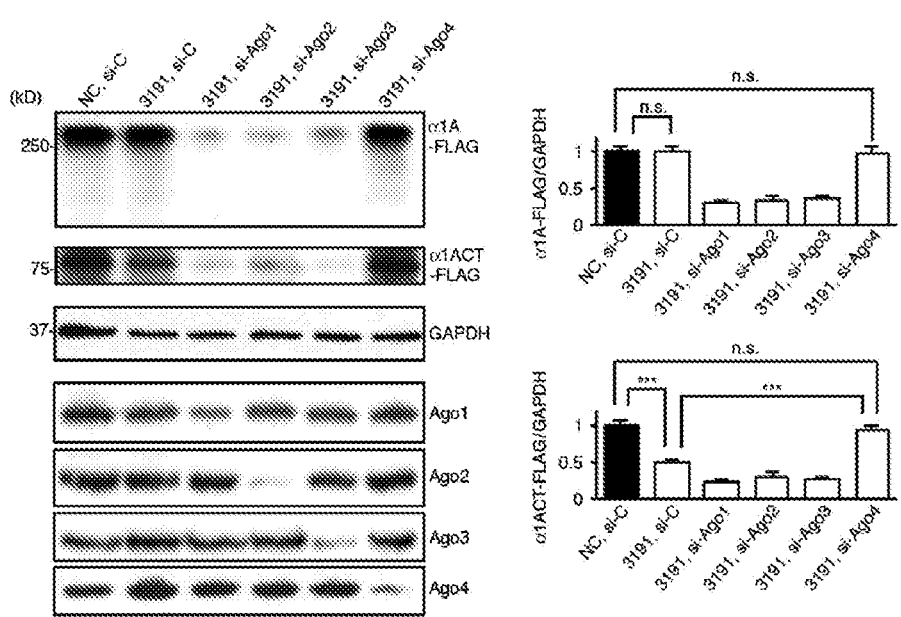

Ago4 is Required for miR-3191-5p-Mediated Inhibition of α1ACT Translation miRNAs generally act on targeted mRNAs in collaboration with the miRNA-induced silencing complex (miRISC)- guided Argonaute (Ago) proteins (25-29). To examine the role of Ago proteins on the inhibitory effects of miR-3191-5p, we cotransfected HEK293 cells with miR-3191-5p and small interfering RNAs (siRNAs) targeting Ago1 to Ago4 carried on either a bicistronic reporter vector bearing the CACNA1A IRES or a control vector. Dual-luciferase assays revealed that knockdown of Ago4, but not Ago1 to Ago3, reversed the silencing effects of miR-3191-5p on the CACNA1A IRES-driven luciferase activities (FIG. 19A). Western blot analyses showed that silencing of Ago4, but not Ago1 to Ago3, also prevented the down-regulation of α1ACT-FLAG expression by miR-3191-5p, suggesting that Ago4 is required for miR-3191-5p-mediated inhibition of α1ACT translation (FIG. 19B).

Figure 20A:
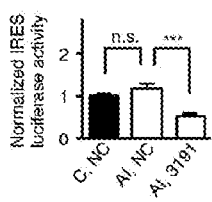
Figure 20B:
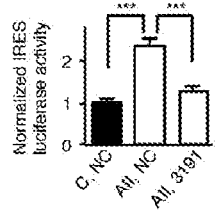
Figure 20C:
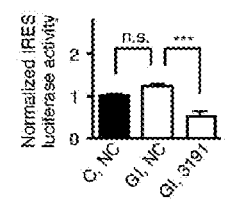
Figure 20D:
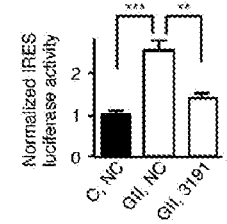
Figure 20G:
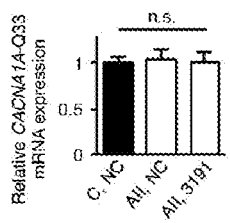
Figure 20H:
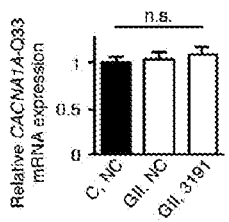

To determine whether Ago4 directly associates with both miR-3191-5p and CACNA1A mRNA or whether Ago4 indirectly mediates the silencing effects of miR-3191-5p, we performed RNA immunoprecipitation-coupled qRT-PCR studies using antibodies specific to Ago1 to Ago4. We found that Ago2- and Ago4-specific antibodies preferentially precipitated miR-3191-5p to a greater extent than did control IgG. Only Ago4-specific antibodies specifically precipitated CACNA1A mRNA, indicating that Ago4 selectively bound to both miR-3191-5p and CACNA1A mRNA (FIG. 19C and FIG. 19D). Ago1- and Ago3-specific antibodies had no effect. We also confirmed that knockdown of Ago4 did not affect miR-3191-5p expression in HEK293 cells (FIG. 19E). These results suggest that miR-3191-5p bound to Ago4 directly interacts with the CACNA1A IRES and selectively inhibits the CACNA1A IRES-driven α1ACT translation.

miR-3191-5p Inhibits the Translational Initiation of CACNA1A IRES-Driven α1ACT by eIF4AII and eIF4GII Because both eukaryotic initiation factors (eIFs) eIF4A and eIF4G have been previously shown to be involved in IRES-dependent translation in several types of viral IRESs (17), we examined the effects of these on CACNA1A IRES-driven α1ACT translation. We found that overexpression of either eIF4AII or eIF4GII, but not eIF4AI or eIF4GI, increased the CACNA1A IRES-driven luciferase activities and that the effects of eIF4AII and eIF4GII were blocked by cotransfection with miR-3191-5p (FIG. 20A to FIG. 20D). Western blot analyses showed that overexpression of either eIF4AII or eIF4GII increased both α1A-FLAG and α1ACT-FLAG expression and that miR-3191-5p reversed the up-regulating effects of eIF4AII and eIF4GII on α1ACT-FLAG expression without affecting eIF4AII and eIF4GII expression (FIG. 20E and FIG. 20F). We also found that overexpression of either eIF4AII or eIF4GII in the presence or absence of miR-3191-5p did not affect CACNA1A mRNA expression (FIG. 20G and FIG. 20H). When we used CACNA1A IRESmut templates, the miR-3191-5p-mediated inhibition of the up-regulating effects of eIF4AII and eIF4GII on both CACNA1A IRESmut dual-luciferase activities and α1ACT-FLAG expression were prevented, indicating that the effects of miR-3191-5p depended on its interactions with CACNA1A IRES (FIG. 29A to FIG. 29D).

Figure 20I:
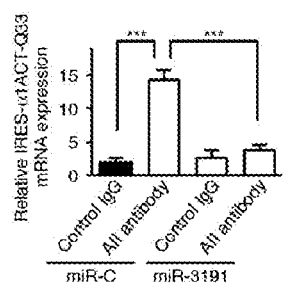
Figure 29A:
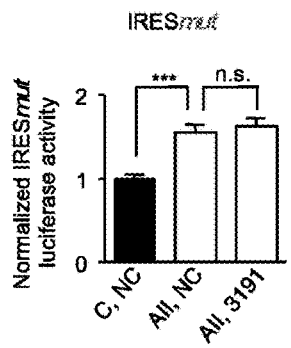
FIGS. 29A-29F provide data demonstrating the effects of eIF4AII and eIF4GII on mutated CACNA1A IRES templates in the presence or absence of miR-3191-5p.
Figure 29B:
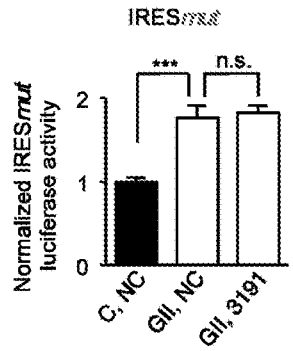
Figure 29C:
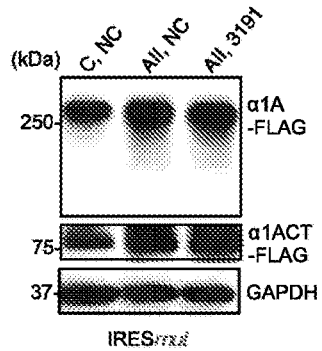
Figure 29D:
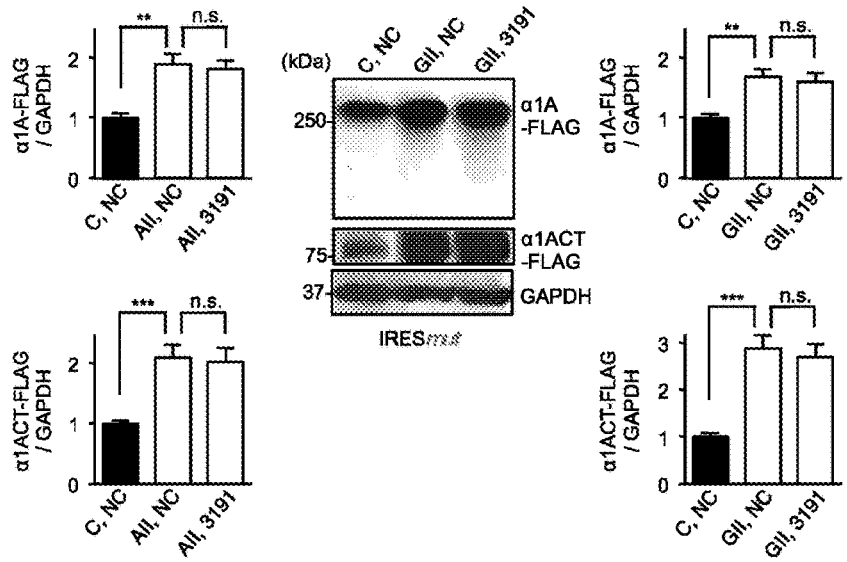
Figure 29E:
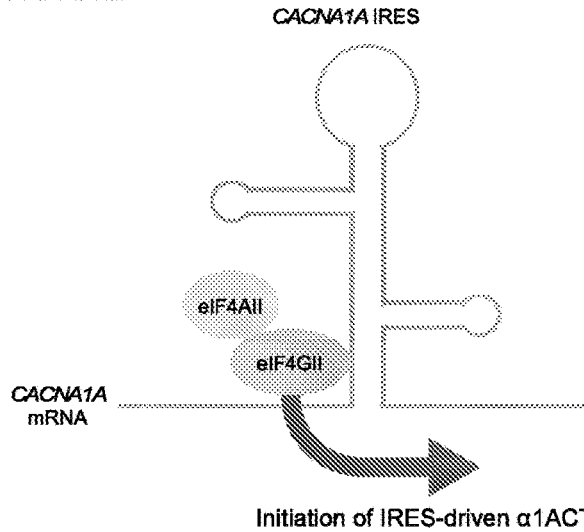
Figure 29F:
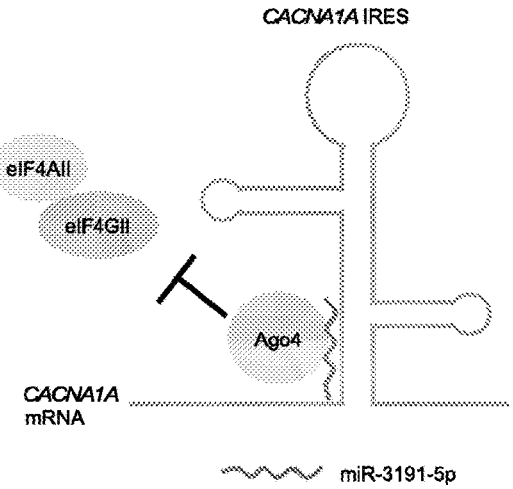
Figure 31A:
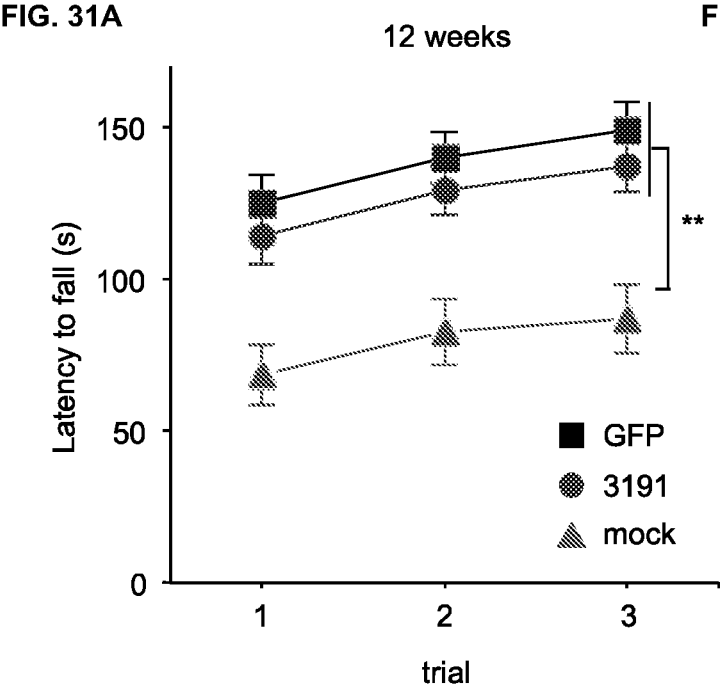
FIGS. 31A-31G demonstrate the long-term follow-up of therapeutic effect of miR-3191-5p on mouse behavioral phenotypes and CACNA1A IRES-driven α1ACTSCA6 expression in mice.
Figure 31B:
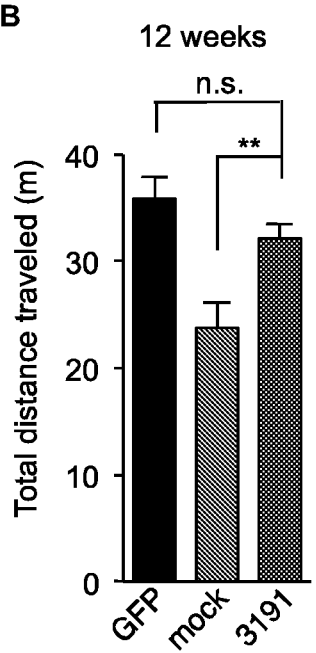
Figure 31C:
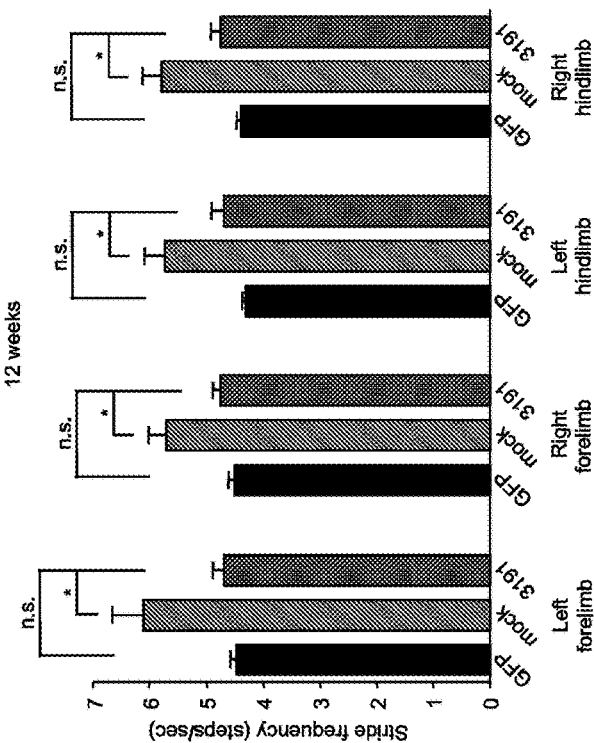
Figure 31D:
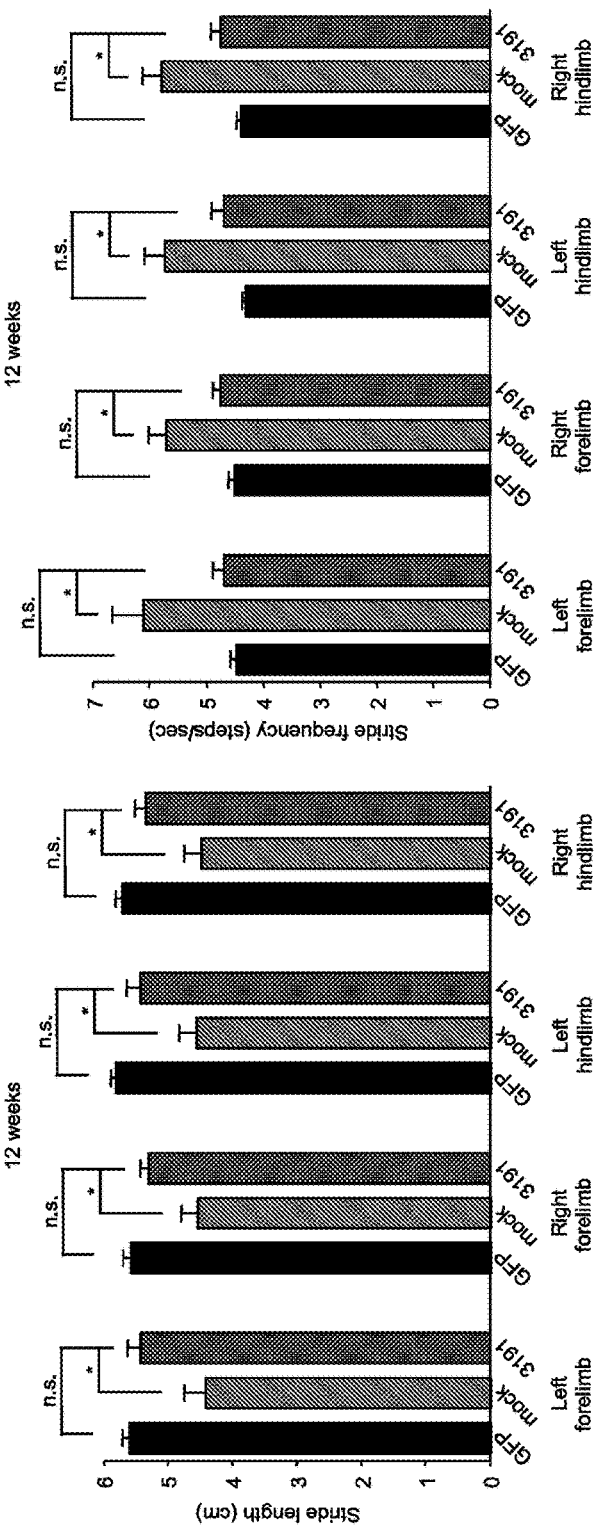
Figure 31E:
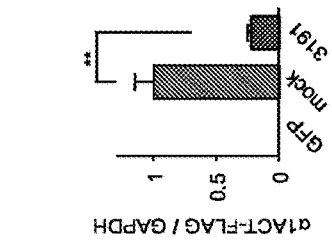
Figure 31F:
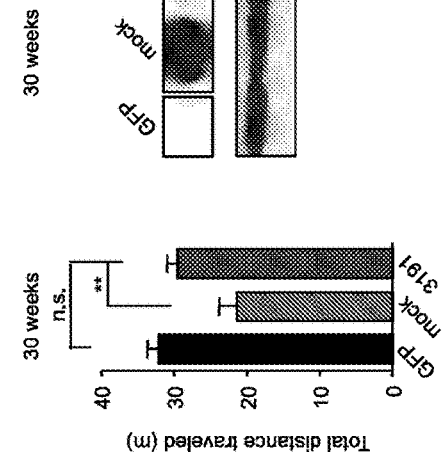
Figure 31G:
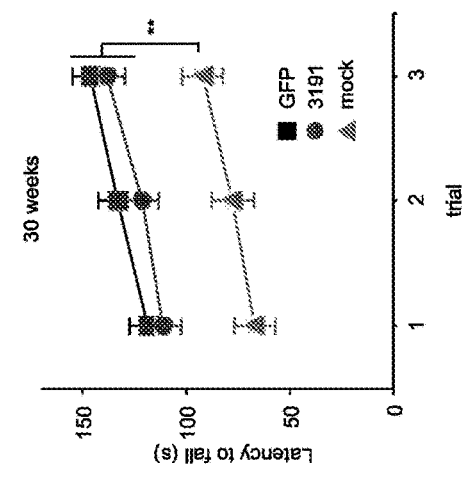

Because both eIF4AII and eIF4GII affected not only CACNA1A IRES-driven translation of α1ACT but also cap-dependent translation of full-length α1A (FIG. 20E and FIG. 20F), we used IRES-α1ACT vectors (FIG. 24A) to test the binding affinities of eIF4AII and eIF4GII to CACNA1A IRES. RNA immunoprecipitation-coupled qRT-PCR studies revealed that both eIF4AII- and eIF4GII-specific antibodies precipitated IRES-α1ACT mRNAs to a greater extent than did control IgG, and that binding affinities between IRES-α1ACT mRNAs and both eIF4AII and eIF4GII were decreased by treatment with miR-3191-5p (FIG. 20I and FIG. 20J). Coimmunoprecipitation studies revealed that eIF4AII associated with eIF4GII (FIG. 20K). We also found that knockdown of eIF4GII had a greater effect on the down-regulation of CACNA1A IRES-driven α1ACT translation than did knockdown of eIF4AII (FIG. 20L). On the basis of these findings, we concluded that the complex of eIF4AII and eIF4GII directly acts on the CACNA1A IRES to enhance IRES-driven α1ACT translation (FIG. 29E). miR-3191-5p bound to Ago4 selectively inhibits the translational initiation of CACNA1A IRES-driven α1ACT by eIF4AII and eIF4GII (FIG. 29F).

miR-3191-5p Prevents Purkinje Cell Degeneration in Mice Caused by CACNA1A IRES-Driven α1ACTSCA6

To examine the therapeutic effects of miR-3191-5p-mediated reduction of CACNA1A IRES-driven α1ACTSCA6 translation on the disease phenotype of SCA6 mice, we constructed an AAV9 vector that allowed for the simultaneous expression of GFP and either miR-3191-5p (AAV9-miR-3191-5p) or a nonspecific mock miRNA (AAV9-miR-mock) (FIG. 30A). We then co-injected AAV9-α1ACT-Q33 with either AAV9-miR-3191-5p (AAV9-Q33-miR-3191-5p) or AAV9-miR-mock (AAV9-Q33-miR-mock) into the right lateral ventricle of neonatal wild-type C57/BL6J mice at postnatal day 1. Four weeks after AAV9 vector injection, we sacrificed AAV9-injected mice and found widespread transduction of miR-mock and miR-3191-5p throughout the brain and cerebellum (FIG. 21A and FIG. 21C). We also found a high efficiency (>80%) of cotransduction of AAV9-α1ACT-Q33 and either AAV9-miR-mock or AAV9-miR-3191-5p in the cerebellum of AAV9-injected mice (FIG. 30B and FIG. 30C). There was a decrease in CACNA1A IRES-driven α1ACT-Q33-FLAG protein expression in the brain and cerebellum of AAV9-Q33-miR-3191-5p mice as compared to AAV9-Q33-miR-mock mice (FIG. 21B and FIG. 21D). Whereas IRES-α1ACT-Q33 mRNA expression in the cerebellum of AAV9-Q33-miR-3191-5p mice was comparable to that for AAV9-Q33-miR-mock mice (FIG. 21E), Western blot analyses supported the silencing effect of miR-3191-5p on CACNA1A IRES-driven α1ACT-Q33-FLAG protein expression in the cerebellum of AAV9-Q33-miR-3191-5p mice compared to AAV9-Q33-miR-mock mice (FIG. 21F). Using RNA immunoprecipitation-coupled qRT-PCR studies, we also confirmed that Ago4 bound to both miR-3191-5p and IRES-α1ACT-Q33 mRNA in the cerebellum of AAV9-Q33-miR-3191-5p mice (FIG. 21G and FIG. 21H).

Figure 23A:
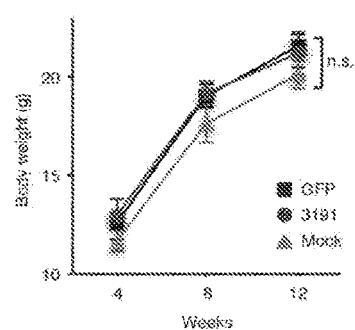
FIGS. 23A-23E provide data demonstrating that AAV9-miR-3191-5p prevents the ataxia and motor deficits caused by CACNA1A IRES-driven α1ACTSCA6 in mice.
Figure 23B:
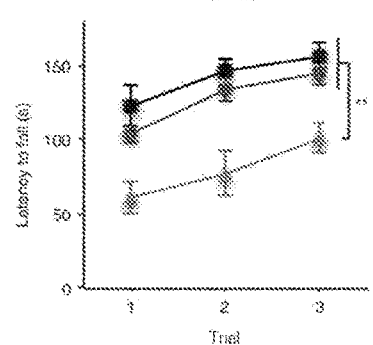
Figure 23C:
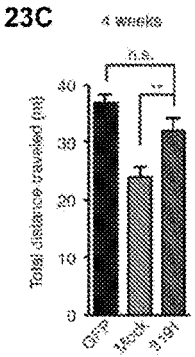
Figure 23D:
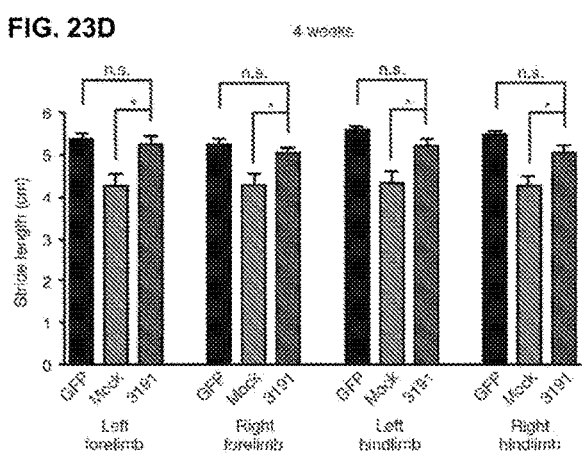
Figure 23E:
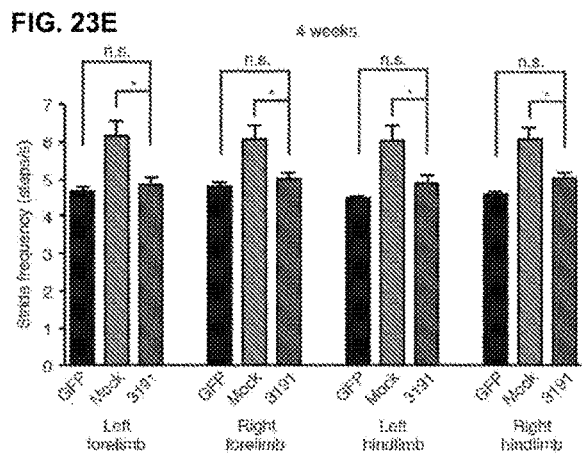

Immunohistochemical examination of AAV9-Q33-miR-3191-5p mouse cerebellum showed that the treatment with AAV9-miR-3191-5p protected Purkinje cells from degenerative changes (FIG. 22A to FIG. 22D). As compared to AAV9-Q33-miR-mock mice, AAV9-miR-3191-5p mice showed protection from thinning of the molecular layer of the cerebellum (P<0.01) (FIG. 22B), decreased density of the dendritic tree (P<0.01) (FIG. 22C), and decreased number of Purkinje cells (P<0.01) (FIG. 22D) caused by AAV9-delivered IRES-driven α1ACT-Q33. These results indicate that AAV9-delivered miR-3191-5p inhibited Purkinje cell degeneration caused by CACNA1A IRES-driven α1ACTSCA6 in mice.

miR-3191-5p Prevents the Ataxia and Motor Deficits Caused by CACNA1A IRES-Driven α1ACTSCA6 in Mice We further examined the therapeutic effect of AAV9-miR-3191-5p on mouse behavioral phenotypes caused by CACNA1A IRES-driven α1ACTSCA6. Although the treatment with AAV9-miR-3191-5p did not affect the body weight of AAV9-Q33-miR-3191-5p mice compared to AAV9-Q33-miR-mock mice (FIG. 23A), we found that the CACNA1A IRES-driven α1ACTSCA6-associated disease phenotypes in AAV9-Q33-miR-3191-5p mice were prevented, as assessed by the rotarod test (FIG. 23B), open-field assay (FIG. 23C), and DigiGait for gait analysis (FIG. 23D and FIG. 23E). AAV9-Q33-miR-3191-5p mice performed significantly better on the accelerating rotarod test (P<0.01) (FIG. 23B) and ambulated a greater distance in the open-field test than did AAV9-Q33-miR-mock mice (P<0.01) (FIG. 23C) at 4 weeks of age. As compared to AAV9-Q33-miR-mock mice, AAV9-Q33-miR-3191-5p mice exhibited improvement of gait instability in all four limbs caused by AAV9-delivered IRES-driven α1ACT-Q33 (P<0.05) (FIG. 23D and FIG. 23E). We also found that treatment with AAV9-miR-3191-5p prevented the weaving steps of AAV9-Q33-miR-3191-5p mice (movies S4 and S5). Furthermore, the therapeutic effect of AAV9-miR-3191-5p on mouse behavioral phenotypes and CACNA1A IRES-driven α1ACT-Q33 expression in the cerebellum of AAV9-Q33-miR-3191-5p mice persisted during long-term follow-up of 30 weeks (FIG. 31A to FIG. 31G).

Although both mature and stem-loop sequences of hsa-miR-3191-5p used in our study are identified in the human genome (miRBase: www.mirbase.org/), those of mmu-miR-3191-5p have not yet been identified in the mouse genome. To identify other potential candidates of hsa-miR-3191-5p-targeting mRNAs in mouse, we first used TargetScanHuman 7.0 (www.targetscan.org/vert_70/) to find the top 100 ranked hsa-miR-3191-5p-targeting human mRNAs. We selected 13 genes with high reliability (cumulative weighted context++ score<−1 and total context++ score<−1) (FIG. 32A). Among these, seven genes (PRX, ZNF781, C22orf46, ZNF23, ZNF286A, ERBB4, and PTBP1) have hsa-miR-3191-5p binding sites within the 3'UTR of their conserved mouse orthologs. We examined the mRNA levels of these seven genes in the cerebellum of wild-type mice injected with AAV9-miR-3191-5p compared to those injected with AAV9-miR-mock. We found that AAV9-miR-3191-5p down-regulated the mRNA expression of mouse orthologs of ZNF781, C22orf46, ZNF23, and ERBB4 by about 50%, whereas those of the other three genes were unchanged, indicating that not all of the predicted mRNA targets were affected by the treatment with AAV9-miR-3191-5p in mice (FIG. 32B to FIG. 32H).

To determine whether an overall change in whole-gene expression in the mouse brain and cerebellum after AAV9-miR-3191-5p injections leads to significant adverse and toxic effects, we monitored wild-type mice injected with AAV9-miR-3191-5p for 12 months and found no abnormal phenotypes. Also, we found no histopathological abnormalities in the brain, cerebellum, heart, lung, liver, and kidney of wild-type mice injected with AAV9-miR-3191-5p (FIG. 33A to FIG. 33F). On the basis of these findings, we conclude that AAV9-mediated delivery of miR-3191-5p is a well-tolerated and successful therapeutic approach for treating the disease phenotype in our SCA6 mouse model.

Discussion

To explore possible therapeutic strategies for treating SCA6, we developed a robust SCA6 mouse model using AAV9-mediated somatic gene transfer of the CACNA1A second cistron to express α1ACTSCA6 under the control of CACNA1A IRES. We found prominent α1ACTSCA6 expression that was predominantly in cerebral cortex and cerebellum of AAV9-injected mice. Mice injected with AAV9 expressing α1ACTSCA6 showed unambiguous disease phenotypes associated with the pathological and clinical features of patients with SCA6 (2-8) much earlier and more reproducibly than the Purkinje cell-specific promoter-driven transgenic SCA6 mouse model we previously developed (11) or the knock-in SCA6 mouse model with polyQ expansion size observed in patients with SCA6 (9, 10). By immunofluorescence analysis, we found that administration of a total of 1010 vg of AAV9 expressing CACNA1A IRES-driven α1ACTSCA6 into the lateral ventricle caused an ~50% decrease in the number of Purkinje cells that was sufficient to lead to early-onset ataxia and motor deficits from an early age. These findings indicate that AAV9-mediated CACNA1A IRES-driven α1ACTSCA6 expression is stronger and therefore more toxic in mouse cerebellum than α1ACTSCA6 expression in previously developed SCA6 mouse models (9-11). These early and severe ataxic phenotypes are also observed in Pumiliol-deficient mice, mimicking SCA1, another type of autosomal dominant SCA (30).

Although we have previously shown that α1ACT functions as a transcription factor essential for cerebellar development (11), the detailed mechanism by which α1ACTSCA6 causes Purkinje cell degeneration in adulthood remains unknown. Because most individuals with SCA6 are heterozygous for the SCA6-causing expansion, that is, they still have one copy of the normal CACNA1A second cistron, they express some levels of the normal α1ACT protein. On the other hand, SCA6 homozygotes that express two copies of mutant α1ACT protein and no normal α1ACT protein develop normally and have nearly the same age of onset as SCA6 heterozygotes (7, 8, 31-33). This confirms that the mutant α1ACT protein fulfills some of the normal α1ACT protein functions in development and that SCA6 arises by a dominant "gain-of-function" mechanism.

In cell culture experiments, we have discovered that miR-3191-5p directly acts on the CACNA1A IRES to regulate the translation of α1ACT in an Ago4-dependent manner. Previous studies have shown that miRNAs, by forming miRISC with Ago1 or Ago2, block the assembly of translation initiation factors to repress either cap- or IRES-dependent translation through their binding to the 3'UTR of targeted mRNA (18-20). There are four members of the RNA-induced silencing complex-related Ago protein family in human Ago1, Ago2, Ago3, and Ago4 (27). Very little is known about Ago4, although the absence of a catalytic domain suggests that it might have a distinct role in gene silencing compared with Ago2 (34-39). Our data showing that Ago4 interacts with miR-3191-5p and CACNA1A IRES to repress translation of the second cistron may suggest that it has a specific role for the mRNA-sparing translational repression via miRISC, possibly even selectively for the translational repression of IRESs.

We have also demonstrated that miR-3191-5p bound to Ago4 selectively inhibits the translational initiation of α1ACT by eIFs, eIF4AII and eIF4GII, which enhance α1ACT expression. Although the list of cellular mRNAs that are thought to contain IRESs is growing (17, 40-42), cellular IRESs show little structural relationship to each other, and their underlying mechanism remains largely unknown but is thought to follow the picornavirus paradigm of binding to the eIF4A-eIF4G complex (17). Identification of eIF4AII, which may provide helicase activity, and eIF4GII, which may serve as a scaffold (17, 43-45), in the mechanism of CACNA1A IRES-mediated translation supports recent findings that show the effect of eIFs on cellular IRESs in human disease (40-42). Presumably, in addition to these eIFs, other IRES transacting factors and small RNAs may play a part in the regulation of CACNA1A IRES-mediated translation (17, 40, 42). The recently recognized abundance of IRES-mediated translational mechanisms in the human genome raises the potential for their role in human disease (46).

We have developed an miRNA-mediated therapy for SCA6 using selective translational blockade of the CACNA1A second cistron in mice. Our findings indicate that continuous inhibition of α1ACTSCA6 expression by the AAV9 vector-mediated delivery of miR-3191-5p has a substantial therapeutic effect on the SCA6 disease phenotype in mice. Considering that an ~50% decrease in the number of Purkinje cells is sufficient to cause ataxia and motor deficits in our mouse model, miRNA-mediated α1ACTSCA6 silencing by blockade of CACNA1A IRES-driven translation in greater than half of Purkinje cells would have great potential benefit in presymptomatic or symptomatic SCA6 patients (13-15).

Although AAV9-mediated intervention with miR-3191-5p did not regulate all of the predicted mRNA targets in our mouse model, we showed that miR-3191-5p has a selective silencing effect on the CACNA1A IRES-driven translation of α1ACTSCA6 in mice. Targeting CACNA1A IRES in SCA6 patients through miRNAs or small molecules may down-regulate both normal and mutant α1ACT. However, AAV9-mediated administration of miR-3191-5p into the lateral ventricle did not lead to any toxic effects in mice during long-term observations over 1 year. Other studies in our group also showed that the effect of α1ACT on establishing normal cerebellar development appeared to be irreversible (47).

There are several limitations to our study. Although patients with SCA6 develop ataxic phenotypes in adulthood (2-8), the targeted expression of α1ACTSCA6 in late adult mouse cerebellum has not been evaluated. Also, the off-target effects due to viral transduction of an miRNA may depend on viral titer and differ among species. A series of reports have suggested that miRNAs may have therapeutic promise for treating cancer, metabolic disease, and inflammation (48-50). However, before miRNAs can have success as therapeutic agents, many challenges remain to be overcome, including their efficient delivery and off-target effects (51, 52). Further studies are needed to validate more efficient and specific targeting strategies to develop an miRNA-based therapy for SCA6 patients in the future.

Although therapy targeting IRES activity has been a mainstay of antiviral therapy, it has not been used for genetic diseases (53-55). IRES-dependent translation also plays a role in the expression of some oncogenes, such as c-myc (56), L-myc (57), and epidermal growth factor receptor (58), in tumors. Our study opens the door to the development of therapies using a new strategy for the selective suppression of IRES-driven pathogenic gene products based on delivery of disease-specific miRNAs.

Example 4

The following example describes the materials and methods used in the study of Example 10.

Study Design

Our study was based on our previous findings that SCA6 is attributable to a polyQ repeat expansion within a second CACNA1A gene product, α1ACT, and that α1ACT expression is under the control of an IRES present within the CACNA1A coding region. The objectives of the current study were threefold. The first objective was to develop an early-onset ataxia model using an AAV9-based gene delivery system to express CACNA1A IRES-driven α1ACTSCA6. The second objective was to identify miR-NAs that target CACNA1A IRES and preferentially block the CACNA1A IRES-driven translation of α1ACT. Finally, we investigated the therapeutic potential of ectopic miRNA expression for the treatment of SCA6 by AAV9-mediated transduction in our previously developed mouse model of CACNA1A IRES-driven SCA6. On the basis of our previous studies (11, 59), four to six biological replicates were used for each in vitro or in vivo biochemical and histological analysis, whereas a sample size of 12 mice (6 male and 6 female mice) per group was used for behavioral testing. For AAV9 injections, neonatal mice were randomly assigned to treatment conditions with equivalent numbers in each group. All behavioral analyses were performed by experimenters who were blind to the identity of treatment conditions. Data collection and the biochemical and histological analysis for mouse samples were performed with the investigators unaware of the sample identities until statistical analyses. All source data are in the Supplementary Materials (table S1).

Construction of DNA Plasmids

We used pcDNA3 vectors expressing CACNA1A-encoded FLAG-tagged peptides (α1A-FLAG and α1ACT-FLAG), a bicistronic CACNA1A IRES reporter vector, and a control reporter vector as described previously (11). We constructed the truncated transgenes of CACNA1A second cistron that lacked the sequence of 5' upstream from CACNA1A IRES (pcDNA3-IRES-α1ACT vectors; FIG. 24A) and inserted them into AAV9 genomes to prepare AAV9-α1ACT-Q11 and AAV9-α1ACT-Q33 (FIG. 24B). Briefly, the sequence of nucleotides 4962 to 7757 of full-length CACNA1A complementary DNA (cDNA) (NM_001127222.1), corresponding to the sequence of CACNA1A IRES and α1ACT ORF, was amplified using IRES-α1ACT primers [5'-ATCAGGATCCGCCCT-CAACACCATCGTGC-3' (forward)(SEQ ID NO: 186) and 5'-GAATCTAGATTACTTGTCATCG-3' (reverse) (SEQ ID NO: 187)] from pcDNA3 vectors expressing CACNA1A-encoded FLAG-tagged peptides. The PCR products were inserted into the Bam HI and Xba I sites of pcDNA3 vectors. We also modified the sequence of nucleotides 5013 to 5015 from "TAT" to "TAG" of stop codon (FIG. 24A).

To obtain mutated CACNA1A IRES transcripts that are resistant to the binding of miR-3191-5p (CACNA1A IRESmut vectors; FIG. 28B and FIG. 28C), we performed C→G and G→C substitutions within the predicted miR-3191-5p binding site. We also performed C→G and G→C substitutions within the complementary binding site of the sequence targeted by miR-3191-5p to maintain the stem-loop structure of CACNA1A IRESmut as same as that of the original. Briefly, we amplified the predicted binding site of miR-3191-5p using miR mut primers [5'-ATGTCTCCGCCCCTGGGTCTccc-cAAcAAcTcTggccCCAGAGTGGCTTACAAGCG-3' (forward) (SEQ ID NO: 182) and 5'-CGCTTGTAAGCCACTCTGGggccAgAgTTgTTggg-gAGACCCAGGGGCGGAGACAT-3' (reverse)(SEQ ID NO: 183)] and the complementary binding site of the sequence targeted by miR-3191-5p using anti-miR mut primers [5'-ACTGAGCACAATAACTTggccAggTTgTTg-gAGGCCCTCATGCTTCTC-3' (forward)(SEQ ID NO: 184) and 5'-GAGAAGCATGAGGGCCTccAAcAAccTggc-cAAGTTATTGTGCTCAGT-3' (reverse) (SEQ ID NO: 185)]. Subsequently, we annealed PCR products using primers anti-miR mut forward and miR mut reverse and inserted the annealed PCR products into the BIp I sites of pcDNA3 vectors expressing CACNA1A-encoded FLAG-tagged peptides and into the Eco RI and Nco I sites of a bicistronic CACNA1A IRES reporter vector.

pDEST-GFP-Ago1 (Addgene, plasmid #21534) and pDEST-GFP-Ago4 (Addgene, plasmid #21536) were gifts from E. Chan (60). pEGFP-hAgo2 (Addgene, plasmid #21981) was a gift from P. Sharp (61). pGEX-GST-AGO3 (Addgene, plasmid #24318) was a gift from C. Novina (34). To create pEGFP-AGO3, we restriction-digested pGEX-GST-AGO3 with Eco RI and Bam HI and inserted it into the plasmid backbone of the pEGFP-hAgo2 after Eco RI and Bam HI digestion.

pcDNA3-HA-eIF4GI and pcDNA3-HA-eIF4GII were gifts from N. Sonenberg (McGill University, Canada) (62). M. Bushell (Medical Research Council, UK) provided us with the plasmids expressing human eIF4AI and eIF4AII (18). pcDNA3.1-HisXpress vector was a gift from T. Cooper (Baylor College of Medicine). From the plasmids expressing human eIF4AI and eIF4AII, we amplified human eIF4AI and eIF4AII cDNAs using eIF4AI-PCR primers [5'-ATCAGGATCCATGTCTGCGAGCCAGGAT-3' (forward) (SEQ ID NO: 188) and 5'-ATCAGGGCCCAGGTCAGCAACATTGAGG-3' (reverse)(SEQ ID NO: 189)] and eIF4AII-PCR primers [5'-ATCAGGATCCATGTCTGGTGGCTCCGCG-3' (forward) (SEQ ID NO: 190) and 5'-ATCAGGGCCCTTAAATAAGGTCAGCCAC-3' (reverse)(SEQ ID NO: 191)], respectively. Subsequently, we inserted the PCR products into Bam HI- and Apa I-digested pcDNA3.1-HisXpress vectors to obtain pcDNA3.1-HisXpress-eIF4AI and pcDNA3.1-HisXpress-eIF4AII. We used the original, either pcDNA3.1-HisC or pcDNA3-HA, vectors lacking the insertions in the multiple cloning sites as control vectors.

Cotransfection of DNA Plasmids with either Synthetic miRNA or siRNA into Cultured Cells HEK293 cells were cultured in Dulbecco's modified Eagle's medium supplemented with 10% fetal bovine serum. All miRNAs and siRNAs were purchased from Life Technologies. ID numbers are shown as follows: miR-711 (MC15715), miR-3191-5p (MC23769), miR-4786-3p (MC21295), a negative control miRNA (#4464059), Ago1 (s25500), Ago2 (s25931), Ago3 (s46947), Ago4 (s46949), eIF4AII (s4570), eIF4GII (s16519), and an siRNA negative control (#12935-300).

We plated HEK293 cells onto six-well dishes and cotransfected each dish with 1.0 µg of the vector expressing the following: bicistronic CACNA1A IRES reporter, bicistronic CACNA1A IRESmut reporter, control reporter, and α1A-FLAG and α1ACT-FLAG; 0.5 µg of the vector expressing the following: eIF4AI, eIF4AII, eIF4GI, and eIF4GII; and either 20 nM synthetic miRNA or 20 nM siRNA molecules. We used Lipofectamine 2000 (Life Technologies) as a transfection reagent in all cases. Neither the miRNA negative control nor the siRNA negative control matched any human mRNA. The transfected cells were cultured for 48 hours before being processed for RNA and protein analysis.

Luciferase Assay

HEK293 cells were plated onto six-well dishes and cotransfected with vectors as shown above. Forty-eight hours after cotransfection, the activities of firefly and Renilla luciferase in lysates prepared from transfected cells using the Dual-Luciferase Assay System (Promega) were measured by using a Wallac 1420 VICTOR3 V luminometer with a 1-s integration time (PerkinElmer). The ratio of firefly luciferase to Renilla luciferase activities of a bicistronic CACNA1A IRES reporter vector was normalized to that of a bicistronic control reporter vector.

Protein Expression Analysis

We did Western blot analysis as previously described (11, 63). We used the following primary antibodies: FLAG-specific antibody (1:5000, A8592 and 1:5000, F1804; Sigma-Aldrich); Ago1-specific antibody (1:2000, 9388S; Cell Signaling Technology); Ago2-specific antibody (1:2000, SAB4200085; Sigma-Aldrich); Ago3-specific antibody (1:2000, 5054S; Cell Signaling Technology); Ago4-specific antibody (1:2000, 6913S; Cell Signaling Technology); eIF4AII-specific antibody (1:2000, ab31218; Abcam); eIF4GII-specific antibody (1:1000, sc-100732; Santa Cruz Biotechnology); GFP-specific antibody (1:2000, M048-3; MBL); and GAPDH-specific antibody (1:5000, AM4300; Life Technologies). We used NIH ImageJ software to quantify the specific expression of individual proteins and demonstrated the relative signal intensities of individual proteins normalized to those of GAPDH in each sample.

Quantitative Real-Time Polymerase Chain Reaction

The total RNA was extracted from HEK293 cells and the cerebellum of mice using the miRNeasy Mini Kit (Qiagen) and reverse-transcribed using the SuperScript VILO (Life Technologies) for mRNA and NCode VILO (Life Technologies) for miRNA. The cDNAs were then used for real-time PCR using the iQ SYBR Green Supermix (Bio-Rad Laboratories). We did the amplification, detection, and data analysis using a Bio-Rad iCycler system (Bio-Rad Laboratories). The crossing threshold values for the mRNAs of the individual genes were normalized to β-actin. The crossing threshold values for miR-3191-5p were normalized to U6 small nuclear RNA. Changes in the expression of mRNA and miRNA were expressed as a fold change relative to the control. We used the following primers. The sequences of the hsa-CACNA1A primers were 5'-GTCTGGG-GAAGAAGTGTCCG-3' (forward) (SEQ ID NO: 192) and 5'-GCTCCTCCCTTGGCAATCTT-3' (reverse) (SEQ ID NO: 193). These hsa-CACNA1A primers discriminated between the human CACNA1A mRNA and the mouse CACNA1A mRNA. The sequences of the hsa-IRES-α1ACT primers were 5'-GTACCTCACCCGAGACTCCT-3' (forward) (SEQ ID NO: 207) and 5'-CGGACACTTCTTCCCCAGAC-3' (reverse) (SEQ ID NO: 208). These primers can also detect the mouse endogenous CACNA1A mRNA. The sequences of the hsa-β-actin primers were 5'-GCGGGAAATCGTGCGTGACATT-3' (forward) (SEQ ID NO: 196) and 5'-GATGGAGTT-GAAGGTAGTTTCGTG-3' (reverse) (SEQ ID NO: 197). The sequences of the mmu-Prx primers were 5'-TTGGTG-GAGATTATCGTGGAG-3' (forward) (SEQ ID NO: 209) and 5'-TCTTGCAAGCTGAGGCTCTTA-3' (reverse) (SEQ ID NO: 210). The sequences of the mmu-Zfp781 primers were 5'-CCTATGAGGATGTGCATGTGA-3' (forward) (SEQ ID NO: 211)and 5'-TGGGGTCCAGAGTGACA-GATA-3' (reverse) (SEQ ID NO: 212). The sequences of the mmu-4930407I10Rik primers were 5'-GAATTCC-CAAGGGCTAAAGTG-3' (forward) (SEQ ID NO: 213)and 5'-TTTCACACCATCTCCACTTCC-3' (reverse) (SEQ ID NO: 214). The sequences of the mmu-Zfp612 primers were 5'-AAGGCAGCCCTCAAGTTAATC-3' (forward) (SEQ ID NO: 215)and 5'-AAGTCTCTGATGCCAGACGAA-3' (reverse) (SEQ ID NO: 216). The sequences of the mmu-Zfp286 primers were 5'-CATGGAAACCAGACCT-GAGAG-3' (forward) (SEQ ID NO: 217) and 5'-ACGCTCACATTCAAGAGCAGT-3' (reverse) (SEQ ID NO: 218). The sequences of the mmu-Erbb4 primers were 5'-CGCTAGAACTCCACTGATTGC-3' (forward) (SEQ ID NO: 219). and 5'-TACCAGCTCTGTCTCCAGGAA-3' (reverse) (SEQ ID NO: 220). The sequences of the mmu-Ptbp1 primers were 5'-TCACCAAGAACAACCAGTTCC-3' (forward) (SEQ ID NO: 221) and 5'-GTGAGCTTG-GAGAAGTCGATG-3' (reverse) (SEQ ID NO: 222). The sequences of the mmu-β-actin primers were 5'-GCTA-CAGCTTCACCACCACA-3' (forward) (SEQ ID NO: 198) and 5'-TCTCCAGGGAGGAAGAGGAT-3' (reverse) (SEQ ID NO: 199). The sequences of the miR-3191-5p primers were 5'-GCTCTCTGGCCGTCTAC-3' (forward) (SEQ ID NO: 200) and 5'-GTCCAGTTTTTTTTTTTTTTGGAAG-3' (reverse) (SEQ ID NO: 201). The sequences of the U6 small nuclear RNA primers were 5'-CTTCGGCAGCA-CATATACTAAA-3' (forward) (SEQ ID NO: 202) and 5'-AAAATATGGAACGCTTCACG-3' (reverse) (SEQ ID NO: 203). We designed the miR-3191-5p primers using a bioinformatics program (64).

Coimmunoprecipitation

We plated HEK293 cells onto 100-mm dishes and cotransfected each dish with 3.0 μg of the vectors expressing eIF4AII and eIF4GII. Forty-eight hours after transfection, we harvested HEK293 cells for immunoprecipitation using eIF4AII-specific antibody (5 μg per sample, ab31218; Abcam), eIF4GII-specific antibody (5 μg per sample, sc-100732; Santa Cruz Biotechnology), and Dynabeads Protein G Immunoprecipitation Kit (Life Technologies) according to the manufacturer's suggested protocols. A rabbit IgG (5 μg per sample, PP64B; Millipore) and mouse IgG (5 μg per sample, CS200621; Millipore) were used as controls.

Immunoprecipitation-Coupled qRT-PCR

We plated HEK293 cells onto 100-mm dishes and cotransfected each dish with 2.0 μg of the vector expressing the following: full-length CACNA1A-Q33-encoded FLAG-tagged peptides, IRES-α1ACT-Q33, miR-3191-5p (SC401396; OriGene), Ago1, Ago2, Ago3, Ago4, eIF4AII, and eIF4GII. Forty-eight hours after transfection, we harvested HEK293 cells for coimmunoprecipitation using Ago1-specific antibody (5 μg per sample, 9388S; Cell Signaling Technology), Ago2-specific antibody (5 μg per sample, 2897S; Cell Signaling Technology), Ago3-specific antibody (5 μg per sample, 5054S; Cell Signaling Technology), Ago4-specific antibody (5 μg per sample, 6913S; Cell Signaling Technology), eIF4AII-specific antibody (5 μg per sample, ab31218; Abcam), eIF4GII-specific antibody (5 μg per sample, sc-100732; Santa Cruz Biotechnology), and Magna RIP RNA-Binding Protein Immunoprecipitation Kit (Millipore) according to the manufacturer's suggested protocols. A rabbit IgG (5 μg per sample, PP64B; Millipore) and mouse IgG (5 μg per sample, CS200621; Millipore) supplied by the manufacturer were used as controls. The immunoprecipitated RNA was reverse-transcribed using SuperScript VILO (Life Technologies) for mRNA and NCode VILO (Life Technologies) for miRNA and analyzed by qRT-PCR for the differential expression of CACNA1A-Q33 mRNA and IRES-α1ACT-Q33 mRNA using the following primers: 5'-GTCTGGGGAAGAAGTGTCCG-3' (forward) (SEQ ID NO: 192) and 5'-GCTCCTCCCTTGGCAATCTT-3' (reverse) (SEQ ID NO: 193), and miR-3191-5p, 5'-GCTCTCTGGCCGTCTAC-3' (forward) (SEQ ID NO: 200) and 5'-GTCCAGTTTTTTTTTTTTTTGGAAG-3' (reverse) (SEQ ID NO: 201). We also extracted RNA and protein complex from the cerebellum of AAV9-injected mice and harvested them for coimmunoprecipitation as same as shown above.

Development of the AAV9 Vectors

The AAV9 vector plasmids contained an expression cassette, consisting of a human cytomegalovirus immediate-early promoter followed by cDNA encoding gene of our interest as shown below, woodchuck hepatitis virus post-transcriptional regulatory element (WPRE), and a simian virus 40 polyadenylation signal sequence between the inverted terminal repeats of the AAV3 genome. The AAV9 vectors expressing α1ACT with either normal CAG repeat size (AAV9-α1ACT-Q11) or mutant CAG repeat size (AAV9-α1ACT-Q33) contained the truncated transgenes of CACNA1A corresponding to the sequence of CACNA1A IRES and α1ACT ORF (IRES-α1ACT; FIG. 24A and FIG. 24B). AAV9-GFP contained cDNA encoding GFP sequence. AAV9-miR-3191-5p contained cDNA encoding GFP and miR-3191-5p sequence (FIG. 30A). AAV9-miR-mock contained cDNA encoding GFP and the miR-mock sequence (FIG. 30A). The sequences of miR-3191-5p and miR-mock are 5'-GGGGTCACCTCTCTGGCCGTCTACCTTC-CACACTGACAAGGGCCGTGGGGACGTAGC TGGCCAGACAGGTGACCCC-3' (miR-3191-5p) (SEQ ID NO: 181) and 5'-GTATTGCGTCTGTACACT-CACCGTTTTGGCCACTGACTGACGGTGAGTGCA-GACGCA ATA-3' (miR-mock) (SEQ ID NO: 206).

We synthesized the AAV9 vp cDNA as previously described with the substitution of thymidine for adenine 1337, which introduced an amino acid change from tyrosine to phenylalanine at position 446 (65). Recombinant AAV9 vectors were produced by transient transfection into HEK293 cells using the vector plasmid, an AAV3 rep and AAV9 vp expression plasmid, and the adenoviral helper plasmid pHelper (Agilent Technologies). We purified the recombinant viruses by isolation from two sequential continuous CsCl gradients, and the viral titers were determined by qRT-PCR as follows: 40 cycles of 95° C./15 s, 60° C./30 s, 72° C./90 s, and 75° C./15 s with WPRE forward primer (5'-ATTGCTTCCCGTATGGCTTTCA-3') (SEQ ID NO: 223) and WPRE reverse primer (5'-TCAGCAAACACAGTGCACACCA-3') (SEQ ID NO: 224) to amplify the sequence of nucleotides 1319 to 1201 of woodchuck hepatitis virus 2.

Injection of AAV9 into the Ventricle of Neonatal Wild-Type Mice

The C57/BL6J mice were purchased from Jackson Laboratory and maintained in our breeding colony. At postnatal day 1, neonatal C57/BL6J mice were individually anesthetized on ice, and a total of 1010 vg in 2 to 4 μl of AAV9 solution were injected into the right lateral ventricle of neonatal C57/BL6J mice with a 10-μl Hamilton syringe attached to a 32-gauge needle (Hamilton Company). The viral solution contained 0.04% trypan blue (Sigma-Aldrich) to help determine whether the ventricles were indeed injected. Only those neonatal C57/BL6J mice in which the lateral ventricles were filled with viral solution were analyzed. Six male and six female mice were enrolled into each group: two groups of AAV9-GFP mice, AAV9-α1ACT-Q11 mice, AAV9-α1ACT-Q33 mice, AAV9-Q33-miR-mock mice, and AAV9-Q33-miR-3191-5p mice. All animal experiments were approved and carried out in accordance with the regulations and guidelines for the care and use of experimental animals at the Institutional Animal Care and Use Committee of the University of Chicago.

Injection of AAV9 into the Ventricle of Neonatal Wild-Type Mice

The C57/BL6J mice were purchased from Jackson Laboratory and maintained in our breeding colony. At postnatal day 1, neonatal C57/BL6J mice were individually anesthetized on ice, and a total of 1010 vg in 2 to 4 μl of AAV9 solution were injected into the right lateral ventricle of neonatal C57/BL6J mice with a 10-μl Hamilton syringe attached to a 32-gauge needle (Hamilton Company). The viral solution contained 0.04% trypan blue (Sigma-Aldrich)

to help determine whether the ventricles were indeed injected. Only those neonatal C57/BL6J mice in which the lateral ventricles were filled with viral solution were analyzed. Six male and six female mice were enrolled into each group: two groups of AAV9-GFP mice, AAV9-α1ACT-Q11 mice, AAV9-α1ACT-Q33 mice, AAV9-Q33-miR-mock mice, and AAV9-Q33-miR-3191-5p mice. All animal experiments were approved and carried out in accordance with the regulations and guidelines for the care and use of experimental animals at the Institutional Animal Care and Use Committee of the University of Chicago.

The Behavioral Assessments of AAV9-Injected Mice

We examined the behavioral assessments of AAV9-injected mice at 4, 8, 12, and 30 weeks of age. The investigators who carried out the behavioral assessments were blinded to the treatment conditions.

Rotarod. We analyzed rotarod test of mice using Economex Rotarod (Columbus Instruments) with accelerating mode (4 to 40 rpm, acceleration with 0.1 rpm per 0.8 s). We performed three consecutive trials with 10-min intervals between each trial.

Open-field assay. We examined open-field assay using Mouse Open Field Arena and 48 Channel IR Controller for Open Field Activity (ENV-510 and ENV-520, Med Associates Inc.). Briefly, mice were placed in the center of the open-field area, and their movements were monitored through the side-mounted photobeams for 30 min. We analyzed multiple parameters using Activity Monitor software (Med Associates Inc.) and adopted total distance traveled to assess the activity of each mouse.

DigiGait analysis. We also examined a video-assisted computerized treadmill for mouse gait analysis using a DigiGait with DigiGait software (Mouse Specifics). All mice were tested at the speed of 25 cm/s.

Immunohistochemistry, Immunofluorescence, and Histopathology

Immunofluorescence was performed as previously described (11, 59) except as modified below. We cut paraffin-embedded sagittally oriented 5-μm sections of mouse brains and cerebellums at 20-μm intervals. We used comparable sections from vermis, medial hemisphere, and lateral hemisphere for staining and histopathological assessments. Paraffin-embedded sections of perfused brains and cerebellums were dewaxed, rehydrated, and then steamed for 20 min in antigen retrieval solution (Reveal, Biocare Medical). Sections were blocked and exposed to primary antibodies for 12 hours at 4° C. After washing, fluorescent secondary antibodies in phosphate-buffered saline and 0.05% Tween 20 were added for 1 hour at room temperature. Confocal fluorescence images were captured with a Leica TCS SP2 laser scanning confocal microscope (Leica Microsystems Inc.).

We used NIH ImageJ software to quantify the FLAG and GFP expression in each section and demonstrated the relative signal intensities of the FLAG and GFP fluorescence per unit area of the mouse hippocampus, cerebral cortex, and cerebellum in each section. The molecular layer thickness and density of Purkinje dendritic trees were calculated as previously described (11, 66). We selected Purkinje cells well stained with GFP- and FLAG-specific antibodies, indicating well transduced with AAV9, and analyzed Purkinje cells (100 to 250 cells per sample) in the entire area of each section to calculate the mean of the density of Purkinje dendritic trees. The dendritic trees of the captured Purkinje cell image and the area enclosed were outlined and measured using NIH ImageJ software. We also calculated the number of Purkinje cells (100 to 250 cells per sample) in the entire area of each section and expressed the results as the number per 250 μm.

We used the following primary antibodies: FLAG-specific antibody (1:200, F1804 and 1:200, F7425; Sigma-Aldrich), GFP-specific antibody (1:200, M048-3; MBL), and calbindin-specific antibody (1:200, CB38a; Swant). Goat Alexa Fluor-conjugated anti-mouse and goat Alexa Fluor-conjugated anti-rabbit IgG antibodies (Life Technologies) were used for secondary fluorescence detection. For the tissue sections stained with hematoxylin and eosin, digital image files were created with a 3D Histech Pannoramic Scan whole slide scanner (PerkinElmer) with a Stingray F146C color camera (Allied Vision Technologies). Individual images were analyzed using the 3D Histech Pannoramic Viewer software (PerkinElmer).

Statistical Analysis

Statistical analysis was performed using ANOVA and Student's t test, unless specified, with the IBM SPSS Statistics 23.0. Two-tailed unpaired t test was used to compare two conditions. One-way ANOVA was used for comparison among multiple experimental conditions. Bonferroni post hoc test was used when comparing among each condition. For the analysis of mouse body weight and rotarod performance, two-way ANOVA was used for comparison among groups. All data represent means±SEM. Statistical significance in figures: $*P<0.05$, $P<0.01$, $*P<0.001$.

REFERENCES

The following represents a listing of the references cited in Examples 1 and 2.
1. A. R. La Spada, et al., Nature Rev. Genet. 11, 247-258 (2010).
2. O. Zhuchenko et al., Nat. Genet. 15, 62-69 (1997).
3. K. Craig, et al., Annals of Neurology 55, 752-755 (2004).
4. C. M. Gomez et al., Annals of Neurology 42, 933-950 (1997).
5. T. Ikeuchi et al., Annals of Neurology 42, 879-884 (1997).
6. Z. Matsuyama et al., Hum. Mol. Genet. 6, 1283-1287 (1997).
7. K. Watase et al., Proc. Natl. Acad. Sci. USA. 105, 11987-11992 (2008).
8. H. Saegusa et al., Mol. Cell Neurosci. 34, 261-270 (2007).
9. X. Du et al., Cell 154, 118-133 (2013).
10. K. Jun et al., Proc. Natl. Acad. Sci. USA. 96, 15245-15250 (1999).
11. V. N. Kim, et al., Nature Rev. Mol. Cell Biol. 10, 126-139 (2009).
12. R. J. Jackson, et al., Nature Rev. Mol. Cell Biol. 11, 113-127 (2010).
13. H. A. Meijer et al., Science 340, 82-85 (2013).
14. T. Fukaya, et al., Mol. Cell 56, 67-78 (2014).
15. A. Fukao et al., Mol. Cell 56, 79-89 (2014).
16. J. R. Lytle, et al., Proc. Natl. Acad. Sci. USA. 104, 9667-9672 (2007).
17. A. Kumar, et al., Genomics 100, 352-356 (2012).
18. C. Shin, et al., Mol. Cell 38, 789-802 (2010).
19. K. Sato, et al., Nucleic Acids Res. 37, W277-80 (2009).
20. B. L. Davidson, et al., Nature Rev. Genet. 12, 329-340 (2011).
21. R. Kole, et al., Nature Rev. Drug Discov. 11, 125-140 (2012).
22. L. Peters, G. Meister, Mol. Cell 26, 611-623 (2007).
23. J. Liu et al., Science 305, 1437-1441 (2004).
24. G. Meister, et al., Mol. Cell 15, 185-197 (2004).
25. R. M. Ewing et al., Mol. Syst. Biol. 3, 89 (2007).

26. P. C. Havugimana et al., *Cell* 150, 1068-1081 (2012).
27. Z. S. Karaa, et al., *RNA*. 15, 249-254 (2009).
28. P. J. Hanson, et al., *Front. Microbiol.* 3, 92 (2012).
29. B. Wang, et al., *Nat. Struct. Mol. Biol.* 16, 1259-1266 (2009).
30. P. K. Juvvuna, et al., *Nucleic Acids Res.* 40, 6808-6820 (2012).
31. N. Wei et al., *PLoS One* 7, e49309 (2012).
32. P. N. Valdmanis, et al., *Nucleic Acids Res.* 40, 3704-3713 (2012).
33. S. Gu, et al., *Curr. Biol.* 22, 1536-1542 (2012).
34. J. Hauptmann, et al., *RNA*. 20, 1532-1538 (2014).
35. A. Dasgupta, et al., *FEMS Microbiol. Lett.* 234, 189-199 (2004).
36. A. V. Gasparian et al., *J. Virol.* 84, 9390-9397 (2010).
37. D. R. Davis, P.P. Seth, *Antivir. Chem. Chemother.* 21, 117-128 (2011).
38. S. L. Lian, et al., *RNA*. 15, 804-813 (2009).
39. A. Gradi et al., *Mol. Cell Biol.* 18, 334-342 (1998).
40. Y. Miyazaki et al., *Nat. Med.* 18, 1136-1141 (2012).
41. P. K. Busk, *BMC Bioinformatics* 15, 29 (2014).
42. A. Iida, et al., *Biomed. Res. Int.* 2013, 974819 (2013).
43. H. B. Kordasiewicz, et al., *Hum. Mol. Genet.* 15, 1587-1599 (2006).
44. T. Miyazaki, M. Watanabe, *Anat. Sci. Int.* 86, 10-18 (2011).

The following references are cited in Examples 3 and 4.
1. La Spada, J. P. Taylor, Nat. Rev. Genet. 11, 247-258 (2010).
2. Paulson, J. Neuroophthalmol. 29, 227-237 (2009).
3. Dun, Lancet Neurol. 9, 885-894 (2010).
4. Zhuchenko et al., Nat. Genet. 15, 62-69 (1997).
5. Craig, Ann. Neurol. 55, 752-755 (2004).
6. Gomez, et al., Ann. Neurol. 42, 933-950 (1997).
7. Ikeuchi, et al., Ann. Neurol. 42, 879-884 (1997).
8. Matsuyama, et al., Hum. Mol. Genet. 6, 1283-1287 (1997).
9. Watase, et al., Proc. Natl. Acad. Sci. U.S.A. 105, 11987-11992 (2008).
10. Saegusa, Mol. Cell. Neurosci. 34, 261-270 (2007).
11. Du, Cell 154, 118-133 (2013).
12. Jun, et al., Proc. Natl. Acad. Sci. U.S.A. 96, 15245-15250 (1999).
13. Seidel, et al., Acta Neuropathol. 124, 1-21 (2012).
14. Rüb, et al., Prog. Neurobiol. 104, 38-66 (2013).
15. Ishiguro, et al, Acta Neuropathol. 119, 447-464 (2010).
16. Kim, et al., Nat. Rev. Mol. Cell Biol. 10, 126-139 (2009).
17. Jackson, et al., Nat. Rev. Mol. Cell Biol. 11, 113-127 (2010).
18. Meijer, et al., Science 340, 82-85 (2013).
19. Fukaya, et al., Mol. Cell 56, 67-78 (2014).
20. Fukao, et al., Mol. Cell 56, 79-89 (2014).
21. Lytle, et al., Proc. Natl. Acad. Sci. U.S.A. 104, 9667-9672 (2007).
22. Kumar, et al., Genomics 100, 352-356 (2012).
23. Shin, et al., Mol. Cell 38, 789-802 (2010).
24. Sato, et al., Nucleic Acids Res. 37, W277-W280 (2009).
25. Davidson, et al., Nat. Rev. Genet. 12, 329-340 (2011).
26. Kole, et al., Nat. Rev. Drug Discov. 11, 125-140 (2012).
27. Peters and Meister, Mol. Cell 26, 611-623 (2007).
28. Liu, et al., RNAi. Science 305, 1437-1441 (2004).
29. Meister, et al., Mol. Cell 15, 185-197 (2004).
30. Gennarino, et al., Cell 160, 1087-1098 (2015).
31. Geschwind, et al., Neurology 49, 1247-1251 (1997).
32. Matsumura, Neurology 49, 1238-1243 (1997).
33. Takiyama, J. Neurol. Sci. 158, 141-147 (1998).
34. Wang, et al., Nat. Struct. Mol. Biol. 16, 1259-1266 (2009).
35. Juvvuna, et al., Nucleic Acids Res. 40, 6808-6820 (2012).
36. Wei, et al., PLOS One 7, e49309 (2012).
37. Valdmanis, et al., Nucleic Acids Res. 40, 3704-3713 (2012).
38. Gu, et al., Curr. Biol. 22, 1536-1542 (2012).
39. Hauptmann, et al., RNA 20, 1532-1538 (2014).
40. Tsai, et al., Open Biol. 4, 140180 (2014).
41. Weingarten-Gabbay, Oncogene 33, 611-618 (2014).
42. Khosrow et al., Am. J. Physiol. Endocrinol. Metab. 301, E1051-E1064 (2011).
43. Pestova, et al., Mol. Cell. Biol. 16, 6859-6869 (1996).
44. Pestova, et al., Mol. Cell. Biol. 16, 6870-6878 (1996).
45. de Breyne, et al., Proc. Natl. Acad. Sci. U.S.A. 106, 9197-9202 (2009).
46. Weingarten-Gabbay, et al., Science 351, aad4939 (2016).
47. Gomez, Two Proteins Encoded by the CACNA1A Gene and Their Role in Cerebellar Development and Disease, Cerebellum Gordon Research Conference, Lewiston, Me., Aug. 12, 2015.
48. A. F. brahim, et al., Cancer Res. 71, 5214-5224 (2011).
49. van Rooij, et al., Circ. Res. 110, 496-507 (2012).
50. Najafi-Shoushtari, et al., Science 328, 1566-1569 (2010).
51. Burnett, et al., Chem. Biol. 19, 60-71 (2012).
52. Zhang, et al., Nat. Commun. 7, 10376 (2016).
53. Dasgupta, et al., FEMS Microbiol. Lett. 234, 189-199 (2004).
54. Gasparian, et al., J. Virol. 84, 9390-9397 (2010).
55. Davis, et al., Antivir. Chem. Chemother. 21, 117-128 (2011).
56. Stoneley, et al., Nucleic Acids Res. 28, 687-694 (2000).
57. Jopling, et al., RNA 10, 287-298 (2004).
58. Webb, et al., Oncogenesis 4, e134 (2015).
59. Kordasiewicz, et al., Hum. Mol. Genet. 15, 1587-1599 (2006).
60. Lian, et al., RNA 15, 804-813 (2009).
61. Leung, et al., Proc. Natl. Acad. Sci. U.S.A. 103, 18125-18130 (2006).
62. Gradi, et al., Mol. Cell. Biol. 18, 334-342 (1998).
63. Miyazaki, et al., Nat. Med. 18, 1136-1141 (2012).
64. Busk, ZMC Bioinformatics 15, 29 (2014).
65. Iida, et al., Biomed Res. Int. 2013, 974819 (2013).
66. Miyazaki and Watanabe, Anat. Sci. Int. 86, 10-18 (2011).

All references, including publications, patent applications, and patents, cited herein are hereby incorporated by reference to the same extent as if each reference were individually and specifically indicated to be incorporated by reference and were set forth in its entirety herein.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted.

Recitation of ranges of values herein are merely intended to serve as a shorthand method of referring individually to each separate value falling within the range and each endpoint, unless otherwise indicated herein, and each separate value and endpoint is incorporated into the specification as if it were individually recited herein.

All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Preferred embodiments of this invention are described herein, including the best mode known to the inventors for carrying out the invention. Variations of those preferred embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

SEQUENCE LISTING (229 sequences)

SEQ ID NO: 1 - DNA, 300019 bp, Homo sapiens
  ref <308>: DATABASE ACCESSION NUMBER: NCBI / NG_011569.1
  ref <309>: DATABASE ENTRY DATE: 2013-05-06
  ref <313>: RELEVANT RESIDUES IN SEQ ID NO: (1)..(300019)
gatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggccatatccttttgcccgaaccccagcagcagctgcgcctccccctcctccctccgcctcccctcttccaggctgggagagagacccgggggttgatgggaggtggggaggaggggggtcttccaggggctgggagagggggcaccgggaggagtgtgaaagaatctctccaccccgagctgggttgagctaccctggaggcttgggaatgggtttgtggggggctggggggtgggcagcggagagtggatccttcccaaggaccgactctagaatgagatctggggcctggggtcgtgcaggagccttggtgggggctttcgagccaagtccggagggtttggagttctacggagtgagcttggagcgggctcgggcctgggcgcttctggccagggcaggggaactatgggggccttggttgggttttcttggccgtcgctcactggagtccacgcaggggaagctggacagcctctccactactgctttccccaaggtggggggccgccgcacttttagggcagggcgcttgggggctcccagggctaagagcaagagggagtccatgtggccttcacactgagaagccagcactggccgaagtgagtaccccagggtgggccgctgttcctatctggagaggatagtgatgggctggggggcgcttatgtttccctcatgtgtgcaggtcccattgcctttaaccgctgattggggaacctcatcatctttgggggtgtcgagaaagagatcccacttgctttatctgggcccctggcctgggaagacctgatctggacactttcagtaagaaagacagggcaacagcaaatgaggtggtgggtccattttagagcaccatgtccagcttttcctaccccgagtagccgagagggaacaccaggagaatcagcacccatgtggacatcttaggtaggtaaatgccttttaaatttttttttttttaatcaaagatccagaggaaaaaggtgaagcccacattttcttctgtggagatgctatcaaaatgcagatcttctgtgtttctttaaatccctgcctgcttgaaataaaccttgaggagggcttaacatctatcgagatgtaggcaggcaagggtgggtaattagtcgggctttctagcagttatctaagcatgacccagattccaggaggggggacacaccctgctgcccaggctggctggccactgtgccatgcccagatgtgccgcttctccgcacagttccaaccagctgccctctgtgtaaaaatgaacgggctggatgggtccctggggctcagcgatgagtcccctatcccttttgtatgtggttttgcagttatagactaaacggggctgggccctgtgtggtctccgggggttgctgtttgaggagcatggcgggtggtagagggactcacttcaggggggttcaaaatcgagcctggcgcttggatcctgggtgctgggattgcaacagagggcactgaggttttggagtgtgtgagtggtctactttgagggtggggaaaattaagaagttcagcagaggtgcttttgaggggagcatacctctaactacgatgccatctccgttggtgcccaaagcaggtgccaggtctttgcttcctaagtttcagactcttaaagaggctggttcttaaggttagcaattcctcaccatcccaggcccattgaagtgctcaggggtggcttgattactctgcctatcaacagagtgaggagtgggagtgccttgcaggaggacagggtattcatgggtgcacacccagttagctccaggagtgagagggctttgctcggctgacaggtttcctcattgaaaatggctttagatcgccttctggagcctggatttggagacttctaagaggaaaggaaggaggtggggagcccttctgctgtgtccttagcttacctctgtccagcctgaatcctgcagattggagggctgttgggggagagggggattgcagtggcccctcggaagggggaatcgtgggagagggaggcaggtgaattgcgagtgttgcttgccacttcatctattctctggccagctcgcccggggctttcttgctcttatgatgagtttgtgcattatgctctctgcagactgtttttgttctctttgacccgaggtaacaaacacattatacagccctactctggaagggaaaactccccacctcacaatctgtcatcgagctgggtcatccaggactgagctttctctgtcctggatggagcggagggcggtggcggggtgggtgggagggttggagatgagaggggatggacagagacctggggagggaggtagtgaataaaagaattcaggccagtgtaaagagaaagacacgtggaatgtcagagtcacgataccagggcagaacattctactttttaatctaaatatttctgccattaaaaaaaaatgtttcagcatatcctgagagtgaaaaaaaaagtgtgtaggtacttaaataaagtctaatatatgtacaggcaagtacatatattcagatgcatagatttttacaaaatgaacacacccacgtatccagcacccaggtcccgatcagtgccctggaagtccccctccccataccgcctcctagttgctcccccaacaagggtaccgctcacctgacttctaaggttcattttgcctcttttaaacatgtaaatggagtcacacagtacgttcttttgccactggcttcttttgctcacatctgtgtatgtgactctactacaatctatccattctactgttgatgggcatttgtgtcatttctgtttgtgccactgggaacattcttgtgtcttctattatttttttcccacagttctcttagataggagtggaatcgcccctgctactttttgatgcatgtgttgtgggatgtgtatttggaaatggtgttgactaagggttgcaggtcgatatggaaagcaggttcctccctgtcttgtttaagagaagtgagtgaatgatccatgaacttgtcggtatgctcacagggcctaagagtgctacttccaaatgtaaattctggcatggtacactggtgaaggatgcagtcttgctttctccacactcggggcaatttgtcactatgatttcttcctctttcatccctcagtgggtcaaacttgaagccatcaatgacaattaagaatcctcatttatttcattttttcccctcttcctaagtgaggaaacccaaatggaagtctttgatgttcaaatttacattgccgtgtttttctcatgccaggcagcaagccgtcttgaccacacaccttggtttcatgttttcattgactggaattgtgattcaaatagggccatgagggtctctgatgattgccgaagagctcagatctgtcagctcaaaaaggagcatctgtcagccttcctagagttccctccccacttaatgccactcactccttctaccaagtgccaaggtgaatgtcatctttccagccctccctgtgccaccaggtctcccactgaacatgatgtagaaactcaggccatcggaggaacactggaagcaggtcagtgtattatcacgcacagttgcctgaattacacgtagaattccagcttttcatccggtttgcagaaatcttaacaagacacctaaagtcacattgacatcaggtgacatcactttgacatctgtggacattggctgattggcactcctctcatttttttttttttttttttttttaagaaaagctctctaaagagaaactttctgcatgagaagcgctgggagacatgggagcaggttatcagactcttggcctgtcctgagagatagaatgttctagaaggtactgccgtagagggcaggatggtgtcacttacgtgatccttgtactagaccggcttggctggtatttccagaggagcaaaattctgcgaagtaaaatttagcacggcttttccaatgggagtattttcaaaaagggtgcaatttcttatccacaattccccaatccaaaaagctccaaaaaccaaaagacgagctcatatagaggtaaaacctaacctgaactgacttcagtttgaagtcttaatttacagttttcattcattctacttggtgtgcatttgagtatgttttgcagcagaaatgttagatgtgcttgatgatgaggtgctgcttcagctcctgactgttaggtctgcattgtagtcctgtcaaactttcaggtgtatggaagttgtcttgttaacaggatggttctggtccagcaggatttgggtggggtctgggattctgcttttctagctagcttctagggattccccatgtggtaagttcatgggctagggttggagtatccaggttagatcatagagacatcttgttatcatttttcttttccttaaaaatcaggtttataggggccgggtctggtggttcacgcctataatcccagcactttgggaggctgaggccggtggatcatgaggtcaggagttcgagaccagcctggccaacatggtgaaaccccgtctctactaaaaatacaaaaattagccaggcgtggtattgtgcgtctataatcccagctactcgggaggctggcaggagaatcatttgaacctgggaggcagaggttgcagtgagccgagattgcaccactgtacttttttttgagactctgtctcaaaaaaaaaatagatttattgatgtataatttatttgtagcaaaattcacccttttgacatactggtctgcaagctttgacaaatggatgtagttgtggccaccacccaaatcaagatatgggacagtttcatcaaccctaaaatacccccacagtgcccctcttgagtcagcaccccacttctccagccccttcaaccactgatctgttctccatccctacagctttgccttttgccgaaggtcatataaatgtaatttcacagtatatagccttttgaatgtggattcttttactcagactttgagattcattcatgctgttgcctgtgacagtagcgccttcctttttggtgttgagcaggattccatgatatggatggaccagagtttgcttcccagccgaaggacattgggatgcttccagtttcaatgattatgaatagagctgctataaacattggcttatgggttttagtgggaacatttcatttcatacatttcatttctcttgggtaaattaacccaggagtgagattgctgagttgtgtggtaggtgtatgtttaattttataagaggctctcaaactgttttcctaagtggttgtaccattttacattcccatctttgcaatgcgtctaaaagccctgagttctgaattccaaagcacgtctggcctcgatggcttaggattaaggatgtggatctatggaaaggagtggaagtaatagtgttaaatcccggtcagagaaataagaaagattaaggatgtcattcaaagctatgtgcctgcactagagagagagaaagaaggggttctcttgggtggggttccacccctccctggtagttctaccattccccaggaaaaagtcaagctctgaggctgtgagacccatgatctttaccctgttcttcaccactgcaaccccagtgtgtgggacaaagcaggcgtcctataaacgtttgctgagcaaatgagaaaaggtacctgtcttcacccattaactaaattgtataacatctatctgatctacccttgtgccaacgttttaggattttgatgggttttagttgcagggggttgagagactgtccatgagattatcagaccaatgaaagtttctgaaatgttagtgcttgagtagattggatgcagcggccccttgagaatgaagtctttcttcagggacttggagtgggaggcatctgttgggtgcgtagggcttatgcttccccctccctgtttcccccccagtagcaagcacacatatacactttctcagcaataaaaagcaccgccgggaaggtggactccatccagaaatgatcagagcctaagagccgtgcagtaacgcatttccgagaatgccagctcagctcctgagaaaagggccggatgggatggtgcctgctctgaaagagggcagagaggagagggaaaacactccggactctgggtcagactggcccaggttcacattattcaccagccatgttatcttgggcaccagagcctatttcttgacatgcatgatgaggatattccttctagtagcatctcccttggagggctctcaggagattaaatggggtcgtgcgtgaaaaatggccagcacagtctccagcacagagaaaaaccccaaaacgccagagccgtaatactatggagtcatttaggttccagtgttctttttttggaaaccggccagaaaagaggctttctgggtgggaatgggagcgaagtgcccccccccaccaccccctgcgactggtcagtgtggattgattaacctgatcgtggcgctctttaaagccacctttggacattttgcattctccgttctctctggaagctttcaggggaaaaaaaattcgtggccacttgacccatttttctattcccttgagtctaaggtaaaaattaattctctttcctcctttggtccctccctctctctgtgggtgacaaggtgagggagttttaaagtatataattagcttccctcttccccttttgcactccctgtctcttcctttggggccggtcgagagtgcagcccaggatggccaccccaggtgtccactgcaaactccacagaaaaactttgctcaacttttggtttagaatttaggtacccccctccccttccaaactttggtcttctttctcctcactccctaaaaaaataggaaaaacaaggaacattcctggcgagggaaccatgagtgggcacagcaacttaggtttcaaaaaccactgggcctcagttcttatctgagtagggtgacccttcagccagggttgcctgggactatcctgggtttagcatctctggaaactcacagtcctgggcaaactgggacgctggtcaccctaatggtgagttcttaacacctgagagagaagaatggtgcaagagatggtgccgttgaccaagaaagggggagagtcagttacttattccctctgaaaagccaagactttttattggaatgaatgcagcttttagaagccgtctttaaggcagctaatacaagagagattccagctatgaagggaaatgcctgagttaagtccggatcaagttttgacatctcgcttcggtcagacacggctttatctgccgttcagactgggagcagccgtgagtcttccttaaaggtgcctgttgctcaggcggcacctgcagttagaaattagcagcctcccacccccagcccccaaataacaggattcaagagtcccctctctgaagccatgagggaaacccaacttagtcacccacttgccagtaaataatattcatgctgttaagttctgttctcattttaggcctatgtgtaaaaaatatatgtaattttaaactgatttttaaagtattttcatacgaacagcatttgcaggagggcgaagtctggatgttacctttttgtaaaagtggatggatttgtcttcaatgagactctggggcagacttaaaacttggcccgcagtggtgttacatggattctgatcttccagagtctgtcacgttcttttatctccatgatctttattatcttctttattgagaatgatgggcatggtgtgtgtgggtgggagggctatgctgaccatcactgcagtgaaatgtgttcgtggcatgttgtggcgtctgcataggaatgtgtctgtttgattaacagcacaagcagtggaggctgtaaggaggaaaagaggagggaaggtgatattggatggaggggagacatatagagcttgggaacagtccaccctggctgcaaatctcagctccagctcacagttgtggagcctcagtcttctcctctgtaaaacggggacagtagtcctatgtccgaggaattgtaagaaggttaaaagatactgtacccagaaagcacatggcatatataatcatcctgtgaagtagccaactcaatgaattttattttatttattttgagtcagagtctcactctgtcacccaggctggagtgcagtggcatgatcatggctcactatagcctcgacctcctaggctcaagcgatcctcctgccttagcctcccgagaagctgggactataggcatgcaccaccgtacccagctttaacaacataaatttatatatatatatatatatatatatatatatatatatatatatatatatatatatatattttttttttttttttttttttttttttttttttgagatggagtttcattcttgttgcccaggctggagtgcaatggcgcgatctcggctcactgcaacctccgcctcccgggttcaagcaggacgatgggcatttgggatgtttctagtttggggtgggggattgtttgtttgtttgctgttatgaacaatgctgctgtaaggaatcaataattttgaatgaatgaattcgaggtgttaattttagtctgtgtacttggaaatctagcttcacctagaatcagctgagattcatcagcatttatggcaggagctaagacatttcacagcttactcatcattttctctaagaggctgggtcaaccggttagctcttggtcctgcttgtattctgagagtcagaacctgtggtttagacactggcaattgatatggttgtagagaagcagcatggttgagttgagagcatggattctggagctaggtggctggggttcaaatcccagctctactagtcactggctgcgtgatcttgggcaagtcacttaagtgttctgtgcttcagtttcccagtctgtcccagtggtgattctaatagctccatggggatcctaatagctcctatctgggaggattaaatgagttaatacatctgatgtttagagtggtgcctgacacttaggaagcactatatgtgtttatacatggaagagtggatagatggatggacttatgtgggtggccatatttgggcttctctgatccactgctgagaatagtgtgtggcacacagtaggtgctgcataagtgttaatattctgctctttcttgccaagtctctcaactcccttgatctctgttatttttggcgtctgtgttgttaacccattcttctgaatgatcagctgaatcactgttgctccaatatataagccaaggagaacacaatcacaaggtctcattgattgtccatactagaattccatgattcctaggcccaagtaggattttccccacgtctcagcaatccttcttccatgtttctaatctttttctctcatttgttatgccccattgccagactctccaatctccccacagcttccccttcctctaactatactgtctctagtcttaccttctccctaagggcaccgtctttgaagacatcaaatacttcagagcaccaaatataggttagcttctctgagggccttacaaggacatggagtgtttgggtcttacacaaattggaatggtcagaaatgtttagagacttgagttgtctttgaaagagttgtcagaatgcaaatttttgacttgtggcctgtttctgatcacaacgcagtcttttaagttatggatcatagctggatgtttgtggtttagaggggatggaggcatcctctgcagttagtgttggatgtctgggtggatggatggatggatggatggatggatggatggatggatggatggttgaacagatgcatggatgagtggatggatggatggatgggatgaaggaaggaaggaaggatgggtgattggagggtaggtgggtggataagtagattggtagatgactcgatgggtgggtggacaaatggatgggtgaatggatgactggatggatgactggatggattggtgtatgagtgaatatatggctggatgaataaataggcagatgactagactggattgaggggtaaaaatatggatgactggatgggtggatgagtggatgatagatggttgaatgggtgggtggatgggtggatgttggatataagggtgtatggtagggtagctgtctatgtgtgggtctccctgatatttggtgttctgtttgacttgggaatgaccaagtctctccgcttaccaccttatttgtaccttttccagtatcaagtgaattttgcacacttttgtaaaaatcaataagattgtatgtttaggactttgggaggccgaggcaggcagatcacaaggtcaggagatagagaccatcctggctaacagggtgaagccccatctctactaaaaatacaaaaaattagccaggcgtggtggcgggcacctgtagtcccagctacctgggaggctgaggcaggagaatggcatgaacccgggaggtggagcttgcagtgagccaagatcatgccactgcactccagcttgggcgacagaacgagactccatctcaaaataaataaataaataaatattatatgcttaggttttacctatgtaattagaaagctccttgagggtaggggacagtgatttgccttcctcacatccccccaaagttcctgcactatatcatgcataagtatttaattgagtaatggtgaggaaagtaaacagtgttattgaacaaagattattaaaattctggaaacacctggttttgtttcagcactgggactgaaagtggaattccttggattttgctccattggtggataggatagcatgtggtggtggactggtagactctttctcttccaagcagattgggtaaatgccccagattcttacccactagtcagagattacagattactgattgatatggtttttctctgtgtccccacccaaatctcatctcaaattgtaatacccacatgtcatgggagggacctggtgaaggtgactggatcatgggggtgatttcccccatgctgttcttgtgatagtgagttctcatgagatctgatggttttaaacttgtgtgggcctctttcctctctctcctctcctgctgccatgtaagacgtgccttgctttccctttgccttctgccatgatttgtaagtttcctgaggcgtccccagccatgcagaactgtgagtcaattgaacctcttttctttataaattacttttatagcagtgtgaaaacggactaacacactgatgtagcaaggtcctttaaggccccatgtgatctggtccctgttttgtctttgatctcatctctttcattgtctaccttcctttcattgtctattctgtctcagccctgctgaccattttactcacacccatgtcatttgcattacatgacattccttctgttcagcataagctatttcctctgcctgcatcactgtttctccaggtctccccatggctaactccttctcttcatttaggtctcagcccaaaagttacctcctccaagaggcctatccttttcatttactgaacatctcatgtacaaaaaagaatataaaatatatgtatactctctcatccacaaaaaaatctctgaagacattttaatgtatttcatcccatacctttttatgcatgtaaacttttaggaacacatttccatgccactaggtatccttgaaaaaataagggccaccatgtatagttgcacaggttgtgcactgcacaaagatagcatgtcacatatcttaagtatcatggagcttgtatgtctactatttcagtaccccagctgataaaagcttaagtatcttgttctagcaagatgaagctattatgacaatttttgacagagaaaggggtgttttgtttaagttcacaatcagagaaatgggtgtcttgtttaatttcacaaccagagaaaggggtgtcttgtttaaattcatacagtggtgctgtatgggttggtggcaaccccagaaaagactgttgttaatatctgataatgttccactttatacgtgtattatattcatgtaacaatctctggctgtttgttttgccattataaataacagtgcagtaaacatctttgtgtgtgaatctctgtccaaggttctgatagttttctgaatgaaattcctgtctatatatggcactccaagcccataattgaaactctgctgttaccactttctttgaatctgtagaaggaattttgagaacaggtgactggtatattcaggatgttgatgacaaggaacagagaaagaacagttaaatggtttggaatttttcctgggctgcatgtaaagcagtgcttttgaactgggagcaatttttcccccaaggggacttttggcaatgtctggagacgtttttggttgtcacgaatgtagggggagggggcaagatgctactggcatctggctggtagaaaccagggatgcagttcagcatcttaaaatgcacaggacagcctttctcagtaaagaattatccagctccaaatgtcagtaataccaaggttgagaaatcttgatgtaatcgatgtcatgggtttcttcaagaggagtgggtggatttagggtttttgggtgacttaaatttaatttacagtttgtcttcctagctgggtgtctaagccagctttctgtgaactttagatcccacacaagaagcaacaggcttgctaccgacagattcgttgatgtaaatatagatgagtgtatagaaggaaatctcacccagagctggaaaatgttggaatgaaaactgcggcggcctccccttctctctccttccccttctgttgccctgtttgaaaatcgtgccttactttctttggtctcctggcatggtgaatgctgctggtatggactgtgtttctatatccccttgatccccacacccttaggaacgtacaggagagagaccctggagcatatcagcttagagatggaggggaatgggaaggagtgcgttcattcattcataaatgttgactgagcacctactgtatgctaggtgaatgggaggacgtgagggcagggaggtgacaaggttggcttattctgggctttgtgaactatggtgaggattttgtttttttccaaaggaaatggaataaccactccttttttccccccgatatacctaaactttttgattttcataacaaaaatgggcttccttttgtatatttgttttgagaccagccgtttttccaccaacactgatcacactgcagtgagcatcctggtagagaagtctttgcacacttctgtcactgtttccctaggacagattcctggaaatggtatggcaaggttgtatgtcaggcttttgggccaggttgcaagaaacaggaagtctgtgccctttcaaattccaaggtcccctttccctgacgacgtggcccaatcaggcttgccctcccttgattttacatcttcaccaatcagataagtgaaagtgaaatcctgttgtggtatcctgtgcatttctttggtgacttaagacatagagcattttccagatctctgtgggctgtttggatatcctttcctctgttttctcaggcacattctttaccgatgtctttgagggattgagcaagtttctgttgaaattgaggcatgtcatggctctgtgtggggcttgaggcagtccagtgtagtggagggagggaggctgtggagcctggctgcctaggttcaaataccaactctgcttatttccattcatatcattttaggcaaatcacttagccccctgggcctgcctttcctcatcagtaaaagtggtataacattagtgcctgcattgtggggtggttgtgaggaaagcagcactcaaaacagtacctgacacacagtgggtgccaaataagagtctgatgtattagtgttataggtatcggcctcctccctccccagtgcaatagtgtgtgtgcgcctctgtgtacctctgttggtgctgacaagccctttttaaaatttagaggtgaggtctcactctgtcccctaggctggagcacagtggtgcaatcatggctcactgcagcctcaaccgcctgggctcaagcaatcctcccagcttagcctcctgagtagttgggactatcggtgtgcaccaccacacctggcccttagacagcccctttatttcaaagcgaaatggcagccacaagatttagtgcaagctctccaagctttaggaccagctgcaactcctctaactgaccaaacaggatcccccatgtccccaacccccaaaacctgatgaaaagcaaacagaccattttccacattcatgacggaaaggcccttttcttggctcctgcccttgctcatgtcaggatttcactccatccctgataaagaggaagcaccatgtcccaggaggacatggaaactctctgctttgtggtgaatagttacagtaacagtagctcctctctgtggggagcttatgagcccctaagctttatagaactgccctggcagtttatgagaacttcatcccagcccccagagctcatggcacttatttttgcccccagtttgcagatgtgcacactgagactcagagagctaacactgcttgccaaggtcacacatctagcaaatggagaaactttatgagacaggtgaaggcacagcaaggataaaaacccagagggaaaaatactcaagttttctccgggaaaccatttgcattccagagaggttggtgtgcgagtgggcaagagatgtcgcgggacgatggttaagggacagagtctgagctcaactaggactaggtttcttcctttccttccttccttcctttcttccttccttcttcctttcctttgtctttctctccctcccttccttcttcctttccttcctttcctttctctttccctccctccctcccttccttcttccttccttactcctttccttccttcctcctttccttcctttcctttctctttccctccttccctccctcccttcttccttcctttctttccttccttcctttttcctttctctttcctttctttcctttccttccttcctctcttcttccttcttttctttctttcttttctctttctttctttctttctttctttctttctttctttctttcctttctttctctctctctctctttctttccttctttctccttccttccttccttcttttcttttcttttcctttcttttcttttgttttttgagatggagtctcgctctgttgcccaggctggagtgcaatggcacaatctcagctcactgcaacctctgcctcccggttcaagcaattttcctgccttggcctcccaagtggctgggactacaggcacgcgccaccacacccagctaatttttgcatttttagtagagatggagtttcaccatgttggccaagctggtctcgacctcttgacctcgtgatcctcctgcctcagcctcccaaagtgctggcattacaggcgtgagctaccacgcctgggctaggactaggtttctatcggtggtgtggcttttgggaagctacctaatcttaaccactctgtttcgtcatctataagataagcagtgtagcattttcttgcaggaatgttgcaaggattaagtggatggtgactgtaaaacatcatgcgtggcacatagtaaattctcagcaggtagtcattgctggtcatttacttttctctaatgaccagcaagctcttaatttcctccttggcatgggcactgggacgtagatggacaaaacacagagagaaataaacacacggacaaaaatccccgccctggtgtggctgatattctgggtggggagagagagggagtccaaggaccagataaacaggtaaaggatagtttgagtgtggtaagtactaaggctcaaaaataaagatctcccaggtgatcttagctgcatttggaggtgacaggagatacaactgagaaactgagataggaggaaacccaaggggagatgtgggcttgatttagggtgatctgaggagtaggagaagtcaggggctggtgtggggaggctctgatggttctctctggggagtgaagcagggattcgttggggagacccaaggggacaggtgaaggcccctgaacaggtggccagtgctgagaaaggaaaggtggaggacccaagtgagttcctaatttcttcattgctcccctaaggtgtttgtctcacccttggccatagtcttggatcacttacagatgcagaccaggctgggctcaatggcttgtgcctgtaatcccagcactttgagaggctgaacccaggagtttgagagcaggctgggcaacatggtgaaaccccgtctctacaaaaaaatacaaaaattggccgagggtgttggcacatgcctgtagtcccagctacttgggaggctgaggtaggaggatctcttgagcccgggagacctatgctgccaaataaggtaggcagtagccacacatggctattgcaattttagaaattaattacaggccacatgtggtggctcacacctgtaatcccaacactttgggaggccgaggcgggcagatcatgaggtcaggagatcgagatcatcctggccaacatggtgaaaccccatctctactaaaaatacaaaaattagctgggcatggtggtgcacacccgcagtcccagctactcgggagactgaggcaggagaattgcttgaacccaggaggcagaggctgcagtgagctgagattgcaccactgcactccagcctgggcaacagagagagactccgtctcaaaaaaaaaaaaaaaaaaaaaaaaaagaaaagaaaagaaattaattacaataaaaacagtccctgagtttcactggccacatttgaagtgcccgatgaccctgtgtggcttagtgaccactgtgctgaatagtgcagatctagagcatcctactggacatgttgccagggtccctgaaccaacagaattagcatctcctgggagcttgttggaaatgcagaatctcatcccctaccccagacctgctcaatcccaatctgctcttcagtgagattcctcaggtgatcttgactgcaccttctaatcacttggaagctttaaaaatgctgaggctgggcacggtggctcacgtgtgtaatcccagcactttaagaggccaaggcgggtggatcacctgaggtcagaagtttgagaccagcctggccaacatggtgaaactccatctctactaaaaattacaaaaattacccaggtgtggtggcacacacctgtagtcccagctacttgggaggctgaggcaggagaactgcttgaacctgggaggtggaggttgcagtaagctgagatggcactgctgcactccagcctgggtgacagagtgggactctgtctcaaaaaaaaaaaaaaaaaaaaaaaaaagaaaagaaaaaggaaaatgctgatgccccaagctccacccccacagatgctggagagatttgtccagggcttcccctggagtggggaatgtttgaaaactccccaagggtttctaaagttcagccagagttagcagaaagcccattaggtggctaagcaggtagactgaagttggagctgtgtgaccttgggcaagccacttaccctctctgaaccacaagctcccttctctctaaaactagagacctgctggcacctccctcccagggctgtgagaagtaaatgatgggatgattcaaagtgctgagtagggtcagatgcagtggctcacacctataatcctagcactttgggacgctgaaatgggaggattgcttgaagccaggagtttgagaccagcctgggcaacatttaaacattacccaggtgtagtggtgcatgcctgtagtcctagctgcttgggaggccgaggtggggggatcccttgagcccaggagttcaaggctgcagtgaacaatgatggtgccactgcactccagcctgggggacaagagtgagaccctatttctaaaaaagaaagaaacccaaaatgctgagcgagtgccttggattgatagtaagcagtgcctgtgtaataagcatgaattttaaaaaatgaggtcagcagccttagagctaatggttaatgggtttgggtgtgggatttttttttttttaatttttaaaacattgagataaaattcccataacataaaattgaccattaaccattttaaagtgtacagtttggtggcatttaatacactcagtgttgtgcaaccatcacctctctgtagttcaaagaccccaaaaaggagaccccgtactcactgagcgctcactccctgtctctccccgctcccccagcccctggcaactactaatcttctgtctgtatagattgacctattctgattttgggggtttttgaactcgccttccctggctgacaacctctcgccatccaggtgagactgtgtgaaagcccagctccctgcatttctgggtcttcctctccccactgggggctgcccccacctgtttccccctctgggcaccctggttctactcatcagcctggcttaatcccagcagcaggtccatgttctgctctcctgtggctgccacaaatgagaggtttcatctcagctgggtttctcctagttaaatatttaataaataagacctacaacttgtgatgctgggagtgtttgatagtgaaattaatgatggggagagagtggcaggcggcccacaggtccatgctggagctgggatgaggcgccctgggcaggcgtccgtgccactgatgcttgggaaccacggtgggccatgccatcccatttcccccagccagggcctcttttttagcactgtgtccagcacagggtagccacctgataaataagtgttaaaagaaagagaggctgcgtgtgtagggaagaaggaagagacagaggagacaaagaggagacacagagagagagagagagatgagagagaaagaaaagtggaaggtgagaaagagacagagatggaaggggagagaaggacctggatggaggaagtgcaaggaaggcaatggtgagggaaaagagagagagacaaagatggaagggatgaaggagagggagagatatggaggtagagaaagagagacagaaagaagagagagaatattgcttcttgtatcttccccttctcctgttatccttgaccatcttattatttttttcttttttctgtctctccagttctcatttccttaccctcgccgtcttgccaactcgtcatctcttttcatttcctgtgtctatgttatcttttaattttctgtctgggtattttccccttttctctttctcagcataaactgttggttggtgtatgtgtcttctttcttttttagtctttaactgacgtgtgtgtgtatgtgtgtgtgtgagagagagagagacagacagacagagagagagagagagagacagaacaaacctagagagcagtgtaggaacatagatgaacattttaaagaccaaaccatgaagcgtacacccattttacccaggtcaagagccacagggccaccatcagattctccctcatgctcatcctcaatcacagccactccttccctcctggaggaaccactattggagattgtatgggaaccattcgcttgctttcttgtgtggttgtaccacctaagtacgcatcctgaagcaatatagtcagatattatgtggttttgagttttatatgaataaaatcatgtgagaggagttgttttgtattttgcttcattggtttgcagttacctttgtgagatttcatcctcattgtggtcactgcagctccttcatgatcttgtttattcattgatgatgagcatgtgactttgttctcttttgggcactggcataagcagctttgttggttgtttatggattctgctgctcgcttgcaggggtctctctggagcacatcgctctgtgtgaaattgttggatactaagatttgtacattttcaccttgactaaacactgccaaacaattttccaaagtgcttgtgctaatttacactcctgccggtggtgggtgagcattcaagatgcttcacaaccttgccaacacttggtattgtcaggtttttaagttatagcctttctcatggtgatttctcattgtgattttagtttgcatcccccgattgcaaattagagtgaacatagtttaaaatatttattgactattcaagcttgcttttttgtgaagtgcctctacatgctctgtccatttttgattaggtcacttttaaaaaaaaaatattgatttgtgggtgatccttacatagcctggaaactgattcttcatcattatatgttgtgcaatattttctcttggcttggcttttgatcttttttataatgtcttttgatcaccaacagttcttaattttgatgtggttgattttagaaatcttttcctttatagtttgtgggctttgtatcttatttaagaaaatcatttctaccctgaggccatggatatattttatgttatttctgaaagttttacagttgtgttcactgtatgtctttaatcagcttgggattgatttttatatgtggtggtaggtaggggtccaatttcctttttattccataagaattgtcccagcatcatttattaaaaagcccattcttgccccaatgatctgcaagacaacctcttgactgtttaacttttaccttctttcatctggtctgtttttatactcaacctttgaagccacaaatatttattgagtgccaactgtgtgccaggcactgagttacagtgacggatatgacagatgcaatcatggctttcatggagtttacagtctggcaaggatgacatgtaaatagttattactacttataatttaaaatgttataggccttgcaaaaagggacaagtctggcttgctctaaaagaaacatgtgaaacaacatcttccagggaagtgctgataaactgagtctttagtgggcctctgctattgtaggggtgggaatggtggaaaagatgttttggccacagggaacagcatgtgcaaaggtcctgtggaaggtgcttaggagtttgatatttatcctaaaggcactgtcaggctactgaagcagtaatacaatgattttatgtctgtgaatagttccactggttgctgcatggagaatgtattggaatacagcaagaataaaaagccatgagaccaattaggaaatgatttcactcattcagggaagtgtgccttgggctggcatggtggctgtggagatggaaatcattgatcagattaaaagaaattttgagctggcatgatttttcccctctctcccctctctctatctctgtttcttttctggttgtgttttctgggtgagaaaagcagtttgtgatcctgccaagggtatgtgctctggaggatgtatttgccacagatggtctttggaattctggccaagagagtcactggacagcccctggcccccagggtttctggagccaattcaacaatgactgtttattaacaacagcaaggatgagttgctagcctttccttcagagcaccttttaactgttaccttactttgttacccaaaccgacactatggaattggtgggggagaagtggaagggtttttatctccattttttatagaacgggggaagttaattggcactcttgaaatcatacaaaagatgttggtttcaggattggtttctggactttcagcccaatcccaattactcaagctcacacacccaatccccaaacatactcttttgcaaataatttccctactgaggtgctcctggccaatttaaaaggtccccatttccttgcctataaaatgggaattaaagtaaaaatatctacctgttgacttgctgtgaggtcagtgggcctgacacatggtgtggactcattatatttacctatgtgaatcccttagttccctttacttggaagaggtggaaaactcaaaggggcttaaacaagaagtggggattgtattggctcatgagactgaagagtctcaggagtgtccagcttcaggcttgtttggatctagggatcagataacaccattaggcctctgtttctgtttcttggctctactttttgcagctggctccattatccatgacttagctgcacttccagccctccagtctgcccaagaccatattcagagagagattcttctctctttttcagctatcttcccggaattttcagcaaatgctttcttgcttttgattggctgttgctgaggtcgtgtgctcatgccagaaccaatcactgtggggaaatgggaggtggagaacggggtgctctgattggcttaggcttgggtcacatgactttatggagttggggtggagccaacttctccaagtggggaagagcagtcttcttaaaggtgtattaggatatgcttgctgctgtaacaagcaacccccaagtctgcagtagcttaaggcaatacgaatgtacttctcactcaccctaaatccaatcagataatcagcaagtggcattccatgtggtgatttcaggacccggctctttccatctgtggctccaccatcccctaagatcagaaagtccttcacttccggcctgtaggaaaagagtatgaaggctcacacaggaagttttgggaggccacatatagaagtagtgaaccttacttctgcctgcattctgtggactggaatttcatcccatggtgtatgagagagggtcccagtaggaaacggaagacacagaccaagaatcaaattaagagatagcttaagaatcaaattaagagatagcttacaaaggtgtgggcccttactgaaatagagaaggaggaagagaggaaggaggcagagacagagagagactgagactcacaaagacacacacacacacacacacacacacacacacacacacacacacacaagttgagagaaagaaggggggagagaaagagagagagggagcatttcctaacaggaagctggcagaataaatgtcccccattgtccaaagccagagggctgggagcccagtgagcccatccacacaggtcagccccccatgtgacagtcctagaagggtaaagaaggaaggagagtggatttggggtaatggaagacagccaatacccatggtccatctgactgcagggggaactgagaaattcagtccatggagaagaaggtttagtggacacgtcactttgtctttttcacaaagtgaaactaggttctcaggtggaaaaaagaaaaagaaggtttgccttgctgctattctttttttttttttgagacggagtctcactctgtcacccaagcgggagtgcagtggcacgatctcggctcactggaagctctgcctcctgggttcacgccattctcctgcctcagcctcccgagtagctgggactacaggcacccaccaccacgcccggctagtttttttgtattttagtagagacggggtttcactgctagccaggatggtctcgatctcctgacctcgtgatccgcccgcctcagcctcccaaaatgctgggattacagacgtgagccaccgcacccggcctccttactgctattcttattattggtggtagcagtggtggtgatggttattggttcttagttccctctacatgccagtatctgctctcttctttttttctcccttacttctttccttgttctgcaaattctttccctttaagtgaaaatctttccgtgttctccaagggagataaattctatgccaagcttgagtgtggggtcctctgcttggatagctgtcttctccaggagatgaggtagaactgagatagtgggggtctctgcaggcagtctgtgcccctggcaagcccctcaccttaacctgaggctgggtggggaaagatgccttgatggagtcagaacagaaagcaagtgatcgctgcctgaaccaagcagtcactttcctggaggtgaaacctagaaacggtccctcaggctgggtccagggaggtggacttgggtcccaggggcaggaagcaacctgcccctcacctgctcctacctctttgtagcctatcttggcaaccagaagtaggtatacaagtgacgttgaagctgggcatgttaacaatggtgtgagcccgcctgactccaatctggtccagctgtactggccgtgcatcctcatctccagcccccagggtcagcccagcggctgtaacaatggtctgtcccctccccgccccacccacttctttgaactcctccaaggatctgtgatgatagggctgtcactgtcttagcttccaccattcaagcttaaccggccttcttcccctccatggagaacggaagagcaacccctcattgcctctggcagctgaccagcaggtccctgccttctgcccactcccaggtctaggacaatgaggtgagaggtagacaggaccaagttccccagtgctgtcttctaggtccacctatcatgagagccgtgattcctagtttttatcaccctctccccaactttgccagctctccacttctggcagtggtggctgcccatgacttcaccttcccgtgcctcagtttcctcatctgtaaaataaggacagccatggtaatgagagttctggtcaatatgccaggcacctcgcttgcatcaatttagctcatcctttcagtgccctgaggggtgggtactgttatcatcccgtgtaacaaaaagagaaaaccgaaacagagagagagactcactatctgaggtcttgcacccctcaagcaacaaaagtgggatttcagcctaggctatctagattcggagtccacggtctcaatgaataataacaacaataataatattgtcctaatctgatgagtttttgatcagattcaatacaagagcataggcagaaaagcttagcccagtgcccagcacatggtaagaactcagcatgttatttataatagtaataaaccattttatgttatgtaattatatattcatagataaatatagttgactcttgaacaacataggggttggggcaatgacctcctgtgcagtcaaaaatgtgtgtgtaactttttttctctattttttagaaattttaaaattagagacaaggtctcgcttttgttgctcaggttgatctcgaactcctgggctcaagtgatcctcctgcctcagcctctcaaagtgctaggattacaggtgtgagcccccgcacccagcctgtgtataacttctgactcccccaaagcttaactactaacagtctattcttgaccagaagccttaccagtaacataaacagtcgatgaagacagattttatatgttatatgcattatatactgtattcttacaataaagtaagctagggaggagaaagtattattttaagaaaatcataaggaagagaaaatatatttactattcattaattggaaagggatcattataaaggtcttcatcctcattgtcttcacattaagtaggctgaagaagaggaggagttggtcttgttgtctcaggggtggcagaggtggaggtggaaggggaggccagaaagacaagcacgcttggtgtaactgttattggaaacaaatctacataagtggacccataaaattcaaacctgagttgttcaggggtcaactatatatgctacaaatacgtaatatgctaatatagttgtatgttattgttatagtacggggatcagaaaatgttttctgcaaaggattagctagaaaatgtctagtaaatactgtctctttgggaccactctactctgccattatagcaaaggcagctacaggcaatacgtaaatgaatgggcatggccatttgccaataaaactttgtttacacaaacaagccatgggccagagtttgtcaacggctggtatagtatatgttattatatattagctttactttttctgttgctttgtttatgttcttctttgcccttcctttcttaaaggccagcctttctttctctctgttggtctgtcttttaggacagcatggcaggccactgggacatgggctctcctgactccaggcttgtttgtctgataagacatgaagagtgaaggtggcaggactctgagctcaggcctgtcctcctcctcttccctctcttcgttttttctttcctctttcctcttttcttcccaagctccagaagttgccattttcctttcccattgctgattttctctgccttgggagaaagcccgagaagatcacttggaaaagcccacgagcatctctggcctcactcacccagctcctgccattgtctttactcttcctcagacacaccaggcacagtcctacctcagggcctttgcactggctgtttcctctgtctgcattgttcttctctcaggtgacctcatggcttctccctcctctccttcaggacttcactcaaaggccaccttctcagcatttgcctcccgcccttctgccttattttcccctttggaacttttcaccttcttacttactcatctgtctgctatctgtcaccctacatcactatgatctccacaagggaaggtgattttattcgttttttgttctgttttgttgaagatgaggttttgctcttgttacccaggctggagtgtggtggcacgatctgggctcactgcaacctccacctcccggattcaagtgagtctcctgcctcagcctcctgagtagctgggattacaggcacccaccaccatgcctggctaatttttgtatttttagtacagatggggtttcaccatgttggccaggctgatctcaaactcctgacctcaggtgatccacccacctcagccttccaaagtgctgggattactgtgagccaccacacctgatcttttggttttacccaccaatgtggactagaacagcctagatcagcaggtggcatgcagtaagcagttgataaatatgtgttggatgagtgagcactgtggcttctgtcattctgttgctcaatagcattcatctggaaataaccacagtttgtttatccatttacctgttgattggcatttctgttgattctcgtttgggccattatgaacaaagctgctgtgaaatacttatacctttgcccaattcttcacttggtgaacccttataaatcctttaggccaggtgtggtagctcacgcttgtaaccccagcactttgggaagccgaggtaggaggatcgctggaggccaggagttcaaaaccagcctgggtaacatagcaagacccgtctctacaaaaaaataaaaaattggctggacgtggcaatgcatgcctgtagttccagctacttaggaggctgaggtgggaagagtgcctgagcccaggagttcaagaccgcagtgagtgatcgcgtcctgcactccaggctgggcgatagagtgagaccctgtctgtaaaaatgacagcaacaacaacaataataaaacctttaggtttcctcttaaaaggaacatccttagagcttttcctgacccagcaactcaccccaagtctgaattagacttcaccccatttctttcataacatttatcacaatgacatgtttattttgtgggggcgggtggcattctggccagaactgtcgacttccagagtgaaaatacggaagaaccaaataaaacacaacacacacatttgcacagcagctcgagggaggtgcttagttctttgagtttccaagaacagagagacgaagatttgtctggggaggaaaaatcagggactgcttcttggaggaggtggactgttgctgccccatccacccacacatttgcagatgtggtgatgagaagatgactgtcacgaggtctctgagcccagggggcccatggttgagtgcaaagatagtggggttgacaaataatcgtcgtataacaaaagaaaagccaccacagttgcataatggaaaggcggcttctatagaacattcagatcatagttgaaggcatgtcacactgtgttactcagaggccactgtcagagccaaaagtgagagtggatgagagtttgggcaggaaacaactgaaccagatacagcatcacctccatgagggctcagctttatctattttgtcttctgttgcatccccagcccttagaacactgcctggtccatctttgctgtgtgaataataataaggaacgatcgctgtgttgagtttgggctgtgaattcagacagtttgctgctgcatacctgattatgagtctcagttttcctcctccataaaatgggcaaaacagtccttgcctcatggggctgtgcatttgtttagcaaacactgaaggagtatacatggtggccaaggcactcttcaagacacaggaagcagacaaaagtccctgccctctgggagcttacatgctcatggggagagatgtatgataagaaacaaaaatagtaggtaagttgcatagtactttagaagattataagggtaatgggaagagaacagcagagaaagggctggggaggcagttgctgtattagatagagctttatcgaggcgatggcattggagccaagacttgaggaagctgtgaggatgtctagagaaagaaggaacagctggtgcaaaggccctgaggtaggggtatatgtgacatgtgtgacagtgaggaggcagatgtggctgaagccagtgagcaagagagagggaaggtgcaaggataaggacagagaggtgacgggacaggttttggagggccttatgggctgcggggaggactttggcttttgctctgagggagctgggagccacggagggcttttgagcagaggagggacgtgacctgactcagatattcataggctcctctggctgctgtgaaaagaacagactttgaaggttgggggcaggcagggcagaagctggggaattaggaaggaggtgacagtgttggtcctggcaggtaatagtgggggtggaaccaggttgttgtctgtggagataataatgagtggctggattctggttataatttttaagtttttttattgtgataaaatgaatttttttattgtgataaaatgaaatttaccactttgaggtgtgcaattccacagcacttactacagtcaccctgttatgcaacagtcacctctatttaatctcagaacatttcatcccccctaaaggaaaccctgcacccattagtagttacttccagtttctcccttcccccagcttctggaaactactaattctggatataagttgaaagttgaccagtaggatttctaggcagacaggtggtgagggctcaatgcattcatgcacagaaagtactcaggtggcatatcataggtgctcaaaactgaaatggtgatgatgagttggcaatgatggtgagtccttccagaatccctgctctagtgctaaactgacctacctggctgtgtagaattctcacctgctggccgggagggtggcagaaccaggatcccttcttacttccagtctggcttgggttagggataggggaggaatgatcagaagaaccaagctagcaccatctgttctggaacatcatccaactcttgtccagatttcccagaactgagcaggaaaatgtccagggaggaacagtgcagctgatggaagtcctggtaagccctggccccagcttcctgagctgctgttgcaccaactagcatttgttggaccttcagtctgagccaagatggcagcttcagaggaagaacaagaagtgtacaagtttctttcatggttgtgtccccgcctccttatatagcctcatataaacccctgcactatcccgttactgtttgcctctccctgaaaagagtgtaaaactcccccactttttccctacttttcacaatgtgttttggtttctaaagatgaaactcctttaattatgttctggttgtaattttctggctccttttatttctcccttacttgatgtattattttcccttgttccttctgccccctgcctccattgatgtttctcttcactgctatctagatttaattctcaactcctgccaagttcagggtgatagtgcaaaaagacatggaccatttagtcttgaattcaggtcccacttctgacaccttcaaagctgctttactttgggcaagtcatatgatcttcctgagggggtatcctttaccttgttcagctaacatttcttgtttttctctgggcacagagtagagtgtcattttccccacctccctgaagttaggtatggctgtgtgatttggtttcatcaatgaaatgtgaggggaagtgacgtgagtccttccggacagaagccttaagggtgagcatgggattcaccatgtttcctttttcctgcctccactgtcatggatgcacaaagatggaccctctctcaaagtaagtgctggagagaggatgacatagatcagtccccatcccacttcatagcatgagtagaaaaatagacctggggtgtgttcaaccactgagatctggggattgtttgttactgcagcaggacatagactaggctgactgtatacctcattatctgcattttggggctgatatctaatcacagtgtctccaggaagattatgttgatgtatgttttagggatggatattcatattttcctataagggctcaataggtttggaaatgtcacatgcatgtaaacttctgattaacaaatatttcttgctttccaatttcttcctatagtgcttctaattttcctgtttttcaatcttgaataaaatgtgagaagtgtttgacttctccttcgaggagattaatggtttctaaagcctggggcattgatttagtcattctcaacctccttgtttctatgacctttttttctccttctctggtcacttagtgtctgctaaggggtgaaggaatgtctgttttaactcattgcattttttttttttttgagacggagtctccctctgttgcccaggctggagtgcagtggtgtgatgttggctcactgcaacctctgcctcctgggttcaagtgattctcctgcctcagcatcccaagtagctgggactacaggtgtctgccaccactcccggctaatttttgtatttttagtagagacggggtttcaccatattggccaggctggtctcgaactcctgaccttgtgatccgcccgccttggcctcccaaagtgctgggattacaggcgtaagccaccacacctggcaaactctttgcatttttaactcttgacatcttcatcttctttttcccacctcccctttgcctgttcctcccctgctcaccccaccagggagtttataatcaggttctagaacctgcaatgtttttctgttgttgtcttccatcttccttgagtcttatgggaatcggccatagtcgcaaattaacaaatagctctgaagcgcctcaagcttggaggcatttccttttgctcacctaagcaagatcctggagctgttgcaaatatcctgccccctactgtaaatctgtcttcatggttgtaagagattcagtcggggtcagtgaagacccgagcaggagatcttggccgaggctccttgatgttctgtctgcgctgggtgttgtcatattgattaagctcctgggactgctgccagcagcctctaggattaaatcaatagagtttgcaaaagtaaaagcttcttttggagacacagaatatgtgggtttattttttaatgataaagcttcaaggagaatcttcatggatggcagaaccagtgatggaaaaggcgaggcagacccaaatatttggggaagtgcagtggggagcaagtgagggaggtttcattgggaggccggggctttccagaaaatctgtttaactggagttgctaatgcaacagctcagagttagaagtgaaggtggaagatgcaagaaggactgccgctgagatgtaaagagaaatgaaggagaggtggatccatttgctcattcaataaacattttgggaggcaggggggtgggggggagcctgccatgtgcctggaactgggatgtacatggtggggacatgacagtgggcaggacagatgtggttcctcctggccctcctggaacttgtaacaggaaaagaaggcataaaataaggaataggcaaatacagacataattactaattgtggtaagtgtttgggagaaaaccagcagggtcctgtgtttgtttcctagggctgccaggacaaattgccatgaactatatggcttaaaacaacataaatatattgtcacccagttctgaaggctggaagaccaaaatcaaggcatcagcagtgctgagctcccttggacggctctagagaagaatgcttccttgattcttccagtttctggtagttgttagcatacattggcttgattggcttgtggctgcatcactgcagtctctgcctctgtcttcacatggccttctccttcatgtcagtgtcttctcttcctcttctctctctctcttttttttttttttgtcagggcctcactctgtcaccctgtacaagagtacagcagtgcaattatagctcactgcaactgctgcttcccagcatcaaacaatcctcccacctcagcctcctgagcagctgggacttacaggcgtgcaccaccatactcagctaatttttaaatttttgatagagatgggatctcactatattgcccagactggtcttgaacttctgggctcaagtgatcctccctcctcagcctcccgaagtgctgggattacaggtgtgagccactgcacctggcctcttctgtctcttataaggatctttgtcgatggattttgagcccgtcagataatccaggacaatctcatcttgagatctctaatttaattatacttgcagaggccgttttactaaataaggtcatggccagaggctccagaggctaaagcatgggtatgattgcaccactgcactttaggctgggtgacagagcaaggccccatctctgaaaaataaaataaaataagtaacctactacaggccctttgcgtagaggataattagaagtacaggggtaccacgtaagtgaagacctgaaggttgttaagcacagagcagagtgtgaacagaatgagacagagggaggaagagaatcccaggcagagggaacagcatgtgcaaaggccctggggaaggaacaagttcatcatgttaaaaatgagccagtgtagctagagtctgatgagcaaagggactcacaggtgggaagacacccaagaagttggcagagacaggtcacacaagaccttctaggtcaagttccggaggtgaactttattctacatgcaatgagaagtcctcagagaagcttaagtgggatgggacagaactgctttactttaaatatatatacatatatacaaacatataatattacatatataaagcatatatatgtatacatatatacatatctatctacctgtctatatattttttagctgggcatggtggctcacacctgtgatcctagcactttgggaggctgaggtgggaggatcacttgagcccaggagttcaagaccagcctgggcaacatagggagaccccatcactacaaataaaaataaaaattaaaaattagctgggtgtgatagtgtgcacctgtagtcccagctacccgggaggctgaggtaggaggattgctggagccccaaaggttgaggctccagtaagccgtgattgtgcccctgcactctagcttgagcaacagagtgagatcctgtctcaataaaataatttttgtattgaggtgaaattcatgcaacataagttaaccattttaaaatgagcaattcagtggcattcagcgcattcacaatattgtacaacctccacctctttctagtgctgaaatattttcatcaccacccctccagaaaaccctgtatccatgaggcagttgctcctcatcctcccctcccggtatccccccaacccccaccactcctggtaactacaaatttgttttctgtttctatggatttacctatactggctctttcatataaatgaattcaggcactgtgtgacctttcgtgtctggcttctttcacttagcataatgccctggcttctctctggagaatgaaatggatagaccactttggagtctactgagattatagatatttctgtgggaagggacagtggcttgaccttgggtggtgctgaagaggcaatgctgagcaggaggattcaaagtctaatttcggaagtagaattggtggggtctgatgatacatcagctgtagggggaggaagatgtaggaactgggaaggtctcttagggtaaccttacctgattgagctccttactaggcagctggtggtacaattcataacaaaggttaatagagaaagagacatgggattagggagggaatggaagagtttgggccttggacactgtagtggtttgaatcctgtccaccaaaaattcagatgcatttggaacttcagaacctgagacctcatttgaaagtaggatctttgcagatgtcattgagtcagggattgagatgaggtcatcctggattacagtggactcgagattccatggtaagtgcttttatatgagaaggtacaggggagaaagtcatgtggcaatagaagcagagaatggagtgctgcagccacaagccaaaagacatgtagaggcaccaaaagcgggaagaggcaaggaaggatcctcccctagagcctttgaagggaaaccccctaatttcagaaccttgcctccaggatgacgagagaataaatttctgttgttttaagccacccaatctgtggcaatttgtcatgactgccctaggagactaatatagacactcctatgagatgctctaagaagacacagagtggtatagctattgctaagaccacacactgtagcagggaggaaatcaaatggagaaatgccccaactccccctcctctctgatctcttgctggtgcctcccgttggccaagccaacccagaaggcagaagatgtggtggagggcagcgttgcagggcttggatgatgcagtcacagaagtcagccctgcctctaccaggatgccaaacagggcaatgagtggatattttagggagaaagggcaacaagagaatggcaaaatacatcgaaatgcatgcaagctctagaaagaggatagagatagataaagggtgattacctaggattaagccccagggaagaccaacatttagagattggatagaaaaagaggagcaaaaagggaagattgagaagtagagaccaggaggataggaggaaaactagaacaacattaagaagggcatggtcaagtaatctgggcacagaaaaatggccctgggatttggcagcctgggggtctttggtgatcctctttggaagagttttggttgagtgatgggggctagaaaccagcctggggagggtaggagaagaatgtgcagtgaggaagtggcaggaacacgtgaaggcaactcttcatgaaggggagtagagaaattggttggtggctgaaggaaaattttcagtcaagggtggaggttttaatgatggaagaatattgatttctgtaaattgggtcattcccatccattataccaatatgcacgggtgtcttctctgatataggatgctgggattctcaaatgcccatttgagtttagcatcatgaatttaatgtcaccagcccagatagttgatctcattcaggaatgctccactgcccaggtatggggaaggcaactagttgagttcatgcagggatggattttttccaggagagaaacaggaggcaagaaagtgcgatataatcaacctatgtaaggttgacaaggcaggagagggtcctgagaaatggcggggtcagtgggttgcagggctcgatgggatggacgttggtttgcatttaagggagttagtgagctgggaggtggttaaagaggaggtggttcagccgggcgcggtggcccacacctgtaatcgcagcactttggggagccgaggcgggcggatcacaaggtcaggcgatcgagaccatcctggctaacacggtgaaaccctgtctctactaaaaatacaaaaaaaaaaaaaaaaattagccaggcgtggtggcgggcgcctgtagtcccagctactcaggagcctgaggcaggagaatggcgtgaacccgggaggcggagctgctgtactccagcctgggcgacagggcgagactccgtctcaaaaaaaaaaaaaaaaaaaaaaaaaaaagaggtggttcaagacaaggatgctggaaacaggtgttttggaggtggctggtgtagcttctgagcatgcatagctggagtggcttggaggagacattggttattgatgaagaggtagggacatcctccagtgatcaaggaagcaggggaccagcatggacaatggtctctccacagggaaattggaggtcatcaaatgttaacaggttccgtcggagtcttagctcccagcttctgttttcctgtggatctcaggatcttggctgctggtgctacctctgactttggacttcccattgagcccagcagcactgggagggaccttcatggcattggctggtttaaggaagacttccttggctttgctgactttcttgggggccttcttggctacacctgcttttgagggagccctcctcacctcacctgacttcttgggggcaccttttccaccttatctgagttgggaaggtctttctttgattctcttgctttcttggggcccttctcactggtttttctgggggccatgatggtggacatattccagagctgagctttccttttgttcttaggaactaatttgaggctgccagtggccccaccttggtcttagagttgatggtctgcagggaatttccaggttaaaggttttttatttgtttgtttaattttgagacagagtcttgctctgtcacccaggttggagtgcagcggcacgatcttggctcactgcagcctccgcctcctgggttcaaacagttttcctgcctcagcctcctaagtagctgggattacaagcacgcaccaccatgcccagctaacttttgtatttttagtggagacagggtttcaccatgttgaccaagctggtctcaaactcctgatctgaagtgatccggccaccttggcctcccaaagtgctgggattacaggtgtgagccactgcgcctgacctccaggtttaagtttaaaccatgaagtagatggactgtgtagagagagaccagggaaatggaggattttactgaccactgaacagggatgtcactattgccagagaggaaaaggattcccccttggtagagtgaacatataagggaaagtggttgaaaattgaatcaggagacagagacctcacaccactcagaggtccctagagaactttactgacctagaaaaaaagataaacagggagaaggtcttcagttcttgtttggaatctgacactgaagcatcctcactcctcactctcttcccgaccccgagagtctgaaattgattaatactttttgtttaaaacttggcttgttgttttgttttttctttctgttttcatcaagggatctttattttacttttgtgtatttgtgtgttttccatgagtcatgttaattcttccatgtttaaactttttggcccagaggaatttatacatttaaattatggatttaatttcagaaggtacatacacacacacacacacacactcactcatctcactttttaaaaactgtaaaatatagccctgtaaatatccagaaaatatctaatgtgggccgggtatggtggctcatgcctgtaatctcagcactttgggaggccgaggtgggtggatcacctgaggtcaggagttcgagactagcctggccaacgtggtgaaaccctatcctcactaaaaataaaaaaattagctgggcatggtggcaggtgcctgtaatcccagctactcgggaggatgagacaggagaatcacttgaacccaggaggcagaggctgcagtgagccgagatcaccccactgcgccccagcctgggcgacagactgagactctgtctcacaaaaaaaaaaaaagaaaagaaaaagtcagtgtgcatcccctctgacatccagcaacttcacatcttggaatttatgctgcaggaaaattatcacaagtgcacaaggatgtatggtgagatagttattattatcattttaaaagatagggtctcactgtgtcacccaggctggagtgcagtgaagtgatcacagctcactgcagccttgaccttctgggctcgagtgatcctcgtgcctcagcctccccagtagctgggattacaggtgtgagccaccatgcctggcatccccctttttttaaaaaaaggttttaattatgaaaagaatatgggcttgttgttttgtgtggttttttaaaagcttaaaaaatgtgtagtgtgtcatttagaaggtgaaaagcccttaccccatcccacctcccagagataacctctgctagcaatttcgtgtttgtctttcaaattttttcccacacacattctttgtactggctgcttcccctcctgggttactcttctcccagacagaaacagggctcattcccttgcctcctccagcttttattaaaacattaacttccctgtagctggatgcagtggctcacgcctgtaatcccagtgttttgggaggtggggaggcaggaggatagcttgagcccaggagtttgagactagcctgggcaacatagcgagacccatctctacaaataaataaataaataaataaataaataaataaataatggaaatttaaaagagagagggaaggactcttgaaaaccgtccatatcatgcttctctaaatggttgagggctcagaggaaaaaaaatcagcaatttcacatcacggaatttattctgcagaaaaattctcacaagtgcacaaggatgcgtggtcagatgatgatgatgatgattattattattattattgaagaaagtagcagcagcagcagcagtattttaaaagacagagtctcggatgggcatggtggctcacgcctgtaatcccagcactttgggaggttgaggtgggcagatcacttgaggtcaggagttcgagaccagtctggccaacatggtgaaaccccaactctactaaaaatgcaaaaattagccaggtatggtggtgggtgcctgcagtcccagctaccagggaggctgaggcacgagaatagcttgaacccaggaaatggaggctgcagtgagccaagatcgtgccactgcactccatgcactccagcctgggtgctgacccaggttaggtgcaagactccgtcttaaaaaaaaagaaaaggaaaaaaaaaaaaaaaggacagagcctcactgtgtcgcccagggtaaagtgcaatgagtaaaggcccatgatgggaaccctgaggagagagtcaaggggaaagaaaaaaaaaaaagcaaaaccaaaatggaatttaaaaaaaatcaggtgcaatttgcataacagaaaattaaccattttaaagtgaacggctctgtggcatttactgcactccaactgttatgtaactaccacctctgtctagctccagaacattttcaccacccctaaaggagaccttgtacccattaagcagtctctctccttctcccctccccaccaccttcctccagcctctggcaaccacccatctgcattctgtctctatggatttacctattctaggtagtcaacaggatgagatatcccaaaagtccatccatggatgaacagataaaccaagtgtgatatgccttcctcagatattagtctgccttaaaaaggaatgaaatactaatctttgctacaacatagatgaacctcaaaaatatgatgtggctggacacagtggcttacacctgtaatcccagaactttgggaggctgaggtgggcggatcgcttgagcccaggtgttcaagaccaccctgggtaacatagcaaaactccatctctacaaaacaatttacaaaaaactagccaggtgtggtgacatgtgcctgtagtcccagctattcaggagactgaggcgagaggatcgattgagcccaggaggccgaggctgcagtgagccatgatcataccactgcactccagcctaggcaacagagtgagaccctatctcaaaaaacaaaacaaaacaaaacaaaaaagttgatgctgagtgaaagaagccagacacaaaaggcaacatcgtgtttaattccatttacatgaaatgtccaatgaagattttttttggcaacatttattttgagtataatattcagtgagtggaccacacatatgcatgcactgcagtatgttcttggaaacatttcagatttgagaggtctgttcagctatgatgacggtaggtattgtcccttccctccctccttgaagaaaaggaactaaggctggacgcggtggctcatgcctgtaatcccagtactttgggaggctgaggtgggcagatcacttgaggtcaggagttcaagactagcctggccaacatggtgaaaccatgtctctactaaaaaatacaaaaaattagccaggtatggtgctgcacgcctgtagtcccagctactcgggaggctgaggcaggagaattgctcgcacccaggaggtggaggctgcagtcaaccgagattgcaccattgcactccagcctgggtggcagagcaagactctgtctcaaaaagaaaagagaagagaagagaaaagaaaagaaaccaaaagaaaaggaaagaaaagaaaaggaaccaagacctagaagggcaaaaataggaaaagttggccgggcgcagtggctcacgcctgtaatcccagcactttgggaggccaaggtgggcagatcacaaggtcaggagatcgagaccaccctggctaacacggtgaaaccccgtctctactaaaaatactaaaaattagccgggcgcggtggcaggcgcctgtaatcccagctactcgggaggctgaggcaggagaatggcgtgaacctgggaggcggagcttgcagtgagccgagatagcaccactgcagtctggcctgggcgaaagagcaagactcggtctctaaaaaaaaaaaaaaaaaaaaaattggaaaagttatttactattagcagcaattgtcataaagtaatgaacatttattgcatgattacaatgagataaattgtatcctgtttttataagcatattaagttttcttttttaaaaaaatgtatgtatttatttattttaagagatagggtcttgctctgttgcccagactggagtgccatggtatgatcatagctcaatgcagcctcaaattcccaggttcaagcaatcttcttgcctcagtctctcgagtagctaggactacaggcatgtgccaacatgcctggctagttttcttatttttaaatgtatttttgtagagacaggatcttgctgtgtcgcccaggctgtcctcaaactcctggcctcaagcgatcctctgccttggcctcccaaagggctgagatgataggcatctacctctgcatttggcccacattaaattttctagtcatcatgggaaccaaaataaacaatataaaacactcacattccttgagcacttactatatgcagggccctgtaatagattattgtgtgtatcagctcattccattctcacacaacctatgaggttgatgctattttctaccttttatatatgaggaaactgaggctcagagaaggaaactgccttgcccaaggtcaaggccacgtctgatccccaaatcctttcaactcctctgcactactattttttagtgcagatattgccagttttctaagcagaagcatgatttagcagccctgagtagacttctcatttcagaaccaaagtgttggacattgttggataatatgaaaaacaaatgacacacaaacctatttgatactgtttttaattttctcttcatttgattttcctgatgacatgattaatcttttttgcctctaccctgtatgtgaaatgtaggtctttgcagatgtctcagagagtgttaatagttgctgctggttttgttttctctccccggggattcccatccctgggtgcaagtgaaattaaacttgtgcctctttgccgctggccgtggtgctgaaaacatcccgggcagcgctagggttgcccttgttagcatgccatccctgctaagagtcttaggctgatcagcgagtggagagatcttttccaggcttcattttggttagaactgtgtgttgaagattttaaagcccatgtctgggaactggagactgtttggattgtttgaagttgaaatagtcatgaataattcctacttgagatgggcttatgagggcgtggactagcatgcaatggttggcctttactaaactgtggccattggttgggacttgggtgaggtgtaacccatttggtctaatccatatggttagggccccaagtgcacctgcattctatttttttttttttttaaataaaggcaaacccatctatcttctaaccaggatagctcctgagtggtctttggggaccaccagcttaaaagcatagactgtgggctgggcacagtggctcatacctgtaatcccagcactttgaaaggccaaggtgagaggatcgcttgagcccaggagttcaagaccagcctaggcaacatggtgagaccctcatctctacaaaaatgttaaaagttagccaggtgtgttggcatgcacctatagtcccagctactcaggaggctgaagtgggtggatcgcttgagcctgggaggtcaaggctacagtgagctgtgatcgtgccactgtatttcaccctgggcaacagagcaagaccctaactcaaacaaacaaacaaaaaaaggcatagactgtggagttgggcagacctgggtgtgagccccagctctgccagtacctcctatgtgaccttgaaaatttgtttaatctctctgagcctggattttcttgtgtggaaaatgaggcttaccacagaacccaccttgtagaaatgttgcaaggaattaactgaaacaaagtgcttaccacggtatctgcccaaagaagcagttggaaacaaggcagctgtaattatggtcgctgtgcttgttaatggccccataatagttgatcatattgcagagtgaaattggggtatgtgtttaatggaccaaggaatatgtcttaaacccatatatctagggttctggtaccctctactctttttcctggtgattgtgatgagcatggaacttacatgaaaatgaggtctgtttggcttcttcacacaagctcaatgacctggctaactgctacaagtatctgtttccttagaacccacccatcagcagtccccatagtggagacaaggtcacaaagagttgacaaacctgatttgatttccgcaccaaccacaggaggcttgaaatgagatgagggtgaagggcaccacagagggatgcaaggattacttggacactgcaaggtcttgctaagggatgggaaccatcagccacgcccactttgagaattttccttcatgttctgaatctgaagagcaaggtcctgttctcagatgcaagccctccttcttccctacgcagagtcaaacttggtcttttccagggtcacatacagcctctctctggggcctctgcaggtcctgatcaatttcattgtgtatagagctctgtgtctcctcacctgcctgcagggctgtctgctatcctgacttccgagagccatttcggaagccagcttttcctcccatcagggatgcttctcttctttcagcccccgccccgctttggcctcctaggatggctgatttttctggatcccgctgacacaggtgctttctctccgagccaatcagggagcagaaaggctcagctcagctaacagaggcattgctcaccgcagctgtgagttagaactcaggctttctaaatcgggaggatcaggcatgacttgaggttgggctgagaaagcctcgcctgccccccagctcgactacccagtgaaacctttggcttctgcctcgggcgaggcatctcttaccatgccaagaactcagcagcccatctttctttcatctgggcaccaagtacatcattgcatatttcagggggtttcattgtgtccttaacatgctcatggagacttggcttgagatgaagtcggggtttctaggcagcaggacccatgtccccttccttcatttcctccaccggtgatttttgttttgttttgttttgttttgttttgttttgttttgtttttgagacggagtctcgttctgttgtccaggctggagtgcagtggcgttatctcggctcactgcaaactctgcttcccgggttcaggtgattctcctgcctcagcctcccaagtagctgagattacaggcgtctgccactatgcccagctaatttttgtatttttagtagagacggggtttcaccatgttggccaggctggtctcgaactcctgacctctggtgatccacccgcctcggcctcccaaagtgctgggattacaggtgtgagccaccgcaccaggcccttccactggtgttttttgagcatctactatatagagaatgctctcctgggcacagaggatgaagcagtgaacaaagtagacaaaaaatccccacgtgcatagagtgtgcagtctcgtgggagagacagggaacaagataaagaaggaaaaaaatagcagatgcttgactggggacggggactaaagaaagaaaaaaataagcaggctaagggggttgatggatgtgacctttgagtaaaggcctaaaggaagtgagggagggagtcatgtggatgtctggggaaagactattccaggagaatgaacagcaggtacaaaggcccctgggtacaaatgtgcctggggagtttggggaataaaagggaggccggcgttgctgtagctgagtgactaagggagagaatagaggagatgaggggagggaggtaatgggagcaggtcatgcaccttgctggtgctggaaggactttgtttttgcttttgagtgagatgggatccatgggaaggctttgaatacttccacatgcattaggctgaaattttcttttctgcttttgtcgcattccaacattgcttttatttcatcaaaatcttcggtttcttctcaggctctttacccaagtgggagcagaaggctggtacccagggctgttcagttctccccctggggtcagaacgtggaggagaaagcttggaggagaaacaggaacccccacctctttctggatgactcaaaaccgcaattacctgagctcctcctcctatccctgaaatagaggcacttagcacttcctaaacttcccggtgcacacaaatcccctggcgatctttttaaatgcaggttctgactcagcaggtggatgcaaggtctaaggctgcattcctaaccggtgctggttctgggaccacactttgagtagcaagggtctgaggtcattgttgcagatgtccatctggggcatgtctgtggacacttgcgggggtgcgggtgagcagagggaggggggatgatgttggaaaagcagtgtgagtatctgtgtttgataagaagtaagaaaatgaagcaaggtgggagagtagaacctctttatttttgcctacgtgctaaggttttattgccatacccagagagccctgggtctgaaatccaggcaacactggccagttgaaaccctgatattgcagcccataaaagtgctgcatgctgcatggtggacttctgggactcttcctggaaccttcagtgccagagccggtccaaaggaagtcacatccctgccattgaggggcaggagaccagggaaccggaggagtgggatggcagaagcgcgtgtaaggaggctgagttggcagggagagaaagcgaagtcagcttcaaatcatagcgagaggagaccagggaagggcttggcgttgctgctctgtgtacaaatattgtctcttattttccaggctgcagggtgaggcagagtggagtatttgtgcaacacagcccagctttgttctctgggctcctaatgcctgtcagctcagaggcagaaagccaatcagagatgatcgtcggcaaggccggcttttgttggctccccaaattgccctgagtctcggattttgcttttcagagtgtgctttcagctggaggcaaaggctgaagctggtgacaaaaggaagcctggttttcctggctttccgagacttttactgagggggtttctatttcagactccgttttcccacctggaaagcaggttccactctccctccggcctggaagggatggttttatggtgcttccaaaatgccaaacctaactccagggcagaagaggagactgaaaccaattaattttccaaaggttagagctacgaggaggggagaggtttagcatggtcaagttccccaagacatactaattgatctctctacagaatgcgggatttcagtgcccccaggggacactcagcaatgtttagagaccacttgaggttgtcatcactggacaggaggggctgctactggcatctagcacacacaggccagggatactgttgaacatgctgcagtgcccagacagccccaccaaggagaatgatccacccctaaacctagtgctgaggttgggaaatcctgctccggagtaaccaacaccctatggctttttcactcaagcagccgcttctccagcgcttacacctcctcagagattgccagatccatatgcagagcctgttggcgtgggacacttctgaggggtgtggcagggagacagcggacattcccatttaccagctgatcagcaggttaggagctaatatgaaatgaacaagatagaccctccccacctgccctgcagatcctctggtgggacactagggagggaggcctcctaaacccaaatgacagttcccaggatgcagggaggagtttacctatgcaaactggagagaatgcaaatggggcatctagagatacttactggacgacccctcccctgcctcgggtcttggaagaacagattctcagaggtctgccctgatcactgtaattttttttttattgaggtaaaattaatataacacaattaaccattttaaagtgacatttagggctgggcacagtggctcatgcctgtaatccccgcactttgggaggctgaggaagaaaggtcgcccaggagttcaagaccaccctgggcaacaaagtaagactctgtctcttacaaaaaaaaaattaggcacacatggtgttgtgcacctgtagtcccagctactcaggaggctgaggcaggaggatcgtttgagcctaggaattcaaggctgcggtgagctatgatcatgccactgcactccagcctgggtgacagagcaaaattgtgtttctttaaaaaaataaaagtaaaaataaataagaaaagaaaggagaggggaggggagaggcgtttagtacactcacaatgttgtgtaactgtcaccttcatctagttctaaaacattaagcagccactcccatttcccttgccattccccaggaacaacaaatctgctgtctgtctctggatttgcctgttcgggatatttcatatacatggaatcatacaatatggggtattttatgtctgcttctttcgcttggcataatgttttcaaggttcattcctgttctatcatgtatcagtacttcattccttttttttttttttttttgaaacggagttttgcttttgttgcccaggctggagtgcaatggcacaatcttggctcactgcaacctccgcctcccgggttcaagcaatcctcctgcctcagcctcctgagtagctgggattacaggcatgcgccaccacacccagctaattttgtactttttttagtagagatggggtttctccatgttggtcatgctggtcttgaactcccaacctcaggtgatctgcctgcctcggccttccaaagtgctgggattacaggcgtgagccactgcacccggcctacttcattcctttttatggctgaatactattccattctatgagtagaccacattttgtttatccattcacccactggtgaaatttaggttgtttccatcttttggctgttgtgaatagtgctgctgtgaatatttgtgtatgagtgttcgttggaatacctgtcttacgatccttttgtgtttataccttggagtggagttactgtgtgtcacatggtaactctgtgattaactttttgaggaaccaaggaatggttttctatggcagttgcactggtgtttttttgttgttgttgtttttgttgttgttgttttgagacagggtctcactcccattgcccaggctggagtgcagtggtgcagtcatggttcactgcagcctcaacctcctggggctcaagcaatcctctctcctcagcctcccaagtagctggcactacaggcctgcgccactatgcccggctaatttttcatattttttgtagagatagagtctcagtttgttgcctaggctggtctcggactcctgtgctcaagtaatcctcctacctcggcctcccaaagtgctgggattacaggcatgagccaccgcatctggccagctacaccattttatattcccaccagcatgagggtttcaatttcttcacatcttcaccaacacttgttttctgtttgtttgtttgtttttaatagctatcctagtggatgtgaagcagtatcccgttggggtttgatttgcacttccctgatcactaataccctcatgtacatattggccatttgactgtcttctttggagaaatgtctattccagcctcctgtccatttttcaattggattatctttttgttgttgtgttgtaaatgttctctctttattttttatttttttgagacagagtctcgctctgtcgcccaggctggagtgcagtggcacgatcttggctcactgcaagctccgcctcccaggttcacgccattctcctgcctcagcctcccgagtagctgggactacagatgcccgctaccacgcccggctaattttttgtatttttttagtagagatagggtttcaccgtgttagccaggatggtctcgatctcctgacctcatgatccacccgccttggcctcccaaagttctgggattacaggcgtgagccaccacacctggccgtaaatgttctttatatagtactagacccttatcagatacatgatttgcaaatagcttctcctattctgttacttgccttttaactttcttgataacgtcctttgatgcacaaaaggtttaaattttgataaagcccagcatatctgttttttcttctgtggatcatgcattaggtgtcaaatctgatcataatgttttatttatttatttacttatttatttattattttatttatttttgagatggagtcttgctctgttgcccaggctagagtgcagtggcatgatctcggctcactgcaacctccacctcccaggttcaagcgattctcctgccccggcctcccaagtagctgggactacaggtgtgtaccaccacgcctggctaatttttgtatttttagtagagacagggtttcaccatgttggccaggctggtctcaaagtcctgaccgcaagtgatccacccaccgcagcctctatctatttttaatttatctctttttttttttttttttttgagacagggcctccttctgtcacccaggctggagtgcagtggtatagtcattgtacactgcagcctctacctcctcggctcaagcaattctctcgcctcagcctcccaagtacctgggaccacaggtgcctgccatcatgctggccctgccaccatatttgaaattgcagccctgaccccttccactgtctatagtcttcaccatcttactacataacatagcatatatgatgtactgtataacatggtatatgcagtgtactgtatagcatagtatacatgatgtagtcatctcatttatttgcttctcctctgggaagcaggaggaagcttctcctcttgtctgctttgctctcaactgtgtccctagcccagaacagagtctggcacacagcaggtactgaatgaatatgtgttcagtgaatattgtgggtgagatagaaggtgaatatccacatttccctttagaagtcacctgatctgggtttgagatctgcagggatctactccagacaggagaacgaataattccacctgtgctgatgagttggaaggatctagagggcttgagatctttccactggggtcagtgggggtgggtgcacctccaacacccttcttttctttgaacaagatttttccttaattccccaatactccctttgaatatatgattttagccaccatcatagcgaattgcatcgtcctcgcactggagcagcatctgcctgatgatgacaagaccccgatgtctgaacggctggtgagtgatgtcttttctcagggtcttctccttggctttagcaggacattaatttttgggggagtggagcagggcacagaggaggctctcagtcctggagcccagagccagatcatgggaagcctaaatttccttttcattttttcttgaaccagagtctcgctctgtcacccaggctggagtgcagtggttcagtcatagctcactgcagcctccacctcctgggctcaagccatcctcccactgcagcctcctgagtagcagggactacaggtgccaccatgcccagttaattttcttatttttatctttttttgtagagatggggatctcactaggttgcttaggctggtctcaaactgcccactttggcatctgacataatttcaggcagtatactcaaatgaacattgttaatgttaataattatgtcttggccagacactgtagctcatgcctgtaatcccagcagtttgggaggccaaggcaggtagatcacttgaggtcaagagttcgagaccatcctgaccaacatggtgaaagcccgtctctactaaaaaaatacaaaattagctggatatggtggtgcacacctgtaatcccagctacttgggaggctgaggcaggagaatcgcttgaacccgggaggcagaggttgcagtaagccaagatcgcaccattgcactccagtctgggcaacaggagtgaaactccatcttggtgggggggaggcgaaaaaaaagaaacaagaatattacaaaggatacagatgaagagatgcaaagggtgagatataggagaagggtgtggctggcagcttctaggtagcttcaggagggggactggtcaccagaaagaccaaggcatgattcgagggttgcgactttcagccccaccccccaacctctgggagggcagaggggctgaaaatcaagttgatcaccaacggtcaatgatttaaatccaaacctctaatcatgccttggttttcccggtgaccaacccccatcctgaagctacctagaagctgccagccatcagtcaatccttagcctgcaaaaagacatccctttggagatcccaagggttttaggagctgtacaccaggaaacagtgtcaaagaccaaacatacatttcacaatgtcacagtcttctaaaaactataactagcctagcaaacctatgatttctagatctttgcattttcacttaaaataaagctaaataaaaagcgtccattgaaagactggtaagcaagtagaagtaccagtggcaagctaatgtggaaaaaaaaaatcattcaggcagagtgaaaatgattgtagctcgagaaacgttgctgtaacagatgggaaaacattcacattggggctctgatggagaagagcttgtagcttaatttcaaatatgatagattagcagctggaagccagaaccagccggaggttctgcagaggaactggaggtgaggatactggccacttatcagccagtacagaagtcctattccaaacctttaacaatctacatgccagctgagaaccatcctaaggggtcagatttaggagtgaggtcaatgcacaagctctagcctcaaataccttgaacgctgcatgtgacaagtaaattctctaaaccaatgctttccattagaactttctgcagtcacagaaatgatctccatctgccctgtccaataggattgtcacttgaaatgtagccagtgtgactgcagaactgtgttttttattttattgcatttaaattaattttaattgaaatagccacatgtggcctgtgactgtcgtattgaataagacaggtgcaaacaaataattctgtttagctgagtgatatgtgaggttggcccaaaaggaatgaaggaggaaggtgccttctctaggcattggctttgctcgcaaaaggctttggacaagagaactctgcaagaggcagtgaggggtggtgagtgcaggagggtcaggggaagtgagagggtgataggtactgatttctaggtgggctggttccctgatcttgtcaacatctgcccagcccaagacgctgaccttgccttctctcccttccaggatgacacagaaccatacttcattggaattttttgtttcgaggctggaattaaaatcattgcccttgggtttgccttccacaaaggctcctacttgaggaatggctggaatgtcatggactttgtggtggtgctaacggggtaagtggcgcgtgctatacgctttggatttaactagctgaaggattacgaggcttttggttggtgtggtccgggccaggctcaggaaggctgagcccttgtgttctccctccccttgttatgcgcctgcctcctttctgccaacaccccacctccatgtctcagctgtatattacagcagatgctttctgttacaattaaaataatagctcattattgttggctgcttccagagtgctttatgcccattctctaatttaatccttgcaacaacccactgaattaggaaatattaatattcccatctgaccactgaggaatcagaaactcagagtgtaacttgcttaaggccacccagcaagtaagtgatggaactgggagatgaacagaagattatgcattccagaactcaaggttttaagtgttgtacgtgcatgggtctcttgatttgcttgaggatatcttgcttttatttcaacttggtgaatgttttttgagaatgtctgggtgcaagggattgtgattatgacaaaggagaaaagcaagctaaataaggtacagttactgtcttcaaggagttttcagatccatatatgatgaactgtggttgaaatgtgtatatgctttcctctaagcaccctgtatgaggtagcacttgctggtataacaaaagatccaaagctaggaaatgacttaaacacggcagaagtttatttgtcactcatagaaaattcaaaattgagctgggtgtggtggtgcatgcctgtaatctcagcactttgggaggctgaggtgggaggatcacttgagctcaggagttcaagaccagcttgggcaacacagtgagaccacccccccatctgtaaaacataaaataaaataaaaattaaccaggcatggtggtacatgcctgggagaattgcttgagctcaggagttggagggcacagtgagctatgatcatccaaccgtgctccagcctgggcaacagagcaagaccccatctcgaaaaaaaaaagtccaaaataattgttcctagttgacaggctcatctcctccaatgactgacggaccctgacccttgccatattgtggctcttcattgtcagcccacatcatccaataactccatgcttgtctgtatcaaaccaggaaggagaagtgagcatagaaggtgatacttggaaaggtttatgagtttggaaggggtgtgacccatacctgttccattcatatcctattggctagaactcggtcacatgaccacacatcactgcaagggaagctgggaagtatcagattgtgcttagaagaaaagggaaatggatttggagaatgacctactagtctgtcagggaccttaaaaacttttattagattccagtagggacattagtatctggtaccaatggctggttcctcctcttcccactctctactctcctctcagctaagtctgggctcttctattctaagacccttcttcactggacacctttttcatagtaatcatttacaggatcatagctttccatgttttgttgctgctccaggttctgtctctcttggcggatgtgatgggttgcagcacccacactgtgctggccgggctctcacaatgcagatttgtttcagagcaatgttgcctctcacagaaggagctgtggcctattgggctgtttctgtagaggccttcagatgtcagcagtctgttgtaaggactctgggctagctctcatgggcttgggtgttcacagagggatctttgttggctgtgctcacagttcggtggcttgggaccttggtgggttccaagggcatattatggtactgggcacttttctcttagtctactaggaaactcatctagaaacagcctagtggctaacttttttattgtttaaaaaatgtaaagctgggcagggtggctcatgcctgtatcccagcacattgggaggccaaggtgggaggattgcttgggcccaggagtttgagacgagcctgagcaacatagcaagaccacatctccacaaaataaaaattaaaagtgtataaagctgggtacagtggcacatgcctgtaaccccaattactcaggaggctggagagagaggattgcttgagcctaactagtttgagaccagcttgggtaacctagcaagatcccatgcaaaactaagtagagaataatagagcaaacacctgtgtatacattcatttattcaatgactatttattgaacacttctgtgtgccaggtcctgttctaggctctgggacacagcagtaaacaaaatagaaaaatcccctgtcctcatggagctgagagtctactgatggagatggacacaattgatgaatgaatctagtgtgtcagatggcggtgaggggtacagaggaaaaataaagcaggggagggatgggatgtgtggcaggcaggggtgaggggtgctggaagccagggaagacttcactgggcatgtgacatctgaatgaaaacctaagggaggtgagtgagtgagccatgaggagagctggaacagagtgtcaggcaaagggaacagccagtgcaaaggctctgaggctggactgtatctgacatgtttgatcaacagtaagaagacccacatggctagagaaggtgaccagaagaatggggagaattggggatagagaagtaatggagtaacctgctatcaaaacacaacctttctctttttttttttttttttttttttgacaagagtctccctctgtcacccaggctggagtgcagtggtacaatctcagctcactgcagcctctgcctcccagtttcaagtgattctcctgcctcagcctcccaagtagcttggattacaggcgtgtaccacaacatctagctaatttttgtatttttagtagagacgggtttacgccatgttggccaggctggtcttgaactcctgacctcaagtgatccacctggcatggcctcccaaagtgctgggattacaggcgtaagccactgtgcccagcaaaacaaaacctttctaacctttctaatccctgttttctccctccctagacccattcctttctctcccccatccaggggcactttcctgaattttatgtttattatttgcatttatgtattcacactttggctgcctaagtatataagaaatatatgctacctatttttacacttcaaaatattttttaaatagcatcagagtgagaatagtttacactttgactacatgcatagataagaaatatgtgggctgggaatggtggctcacacctgtaatcctagcaattttggaggcaaagatggaaggattactttaggccagaagtttgagaccagcctggccaatgtagtgaaaccctgtctctacaaaatgaaataaaatgtaataaaatattcagctgggcatggtggtgtgctcctgtggtcccagctactcaggaggccaaggcgggaggatcacttaagcccataaggtcgacgctgtagtgagctatgactgcactccagcttgggcaacagagcaagaccctgtccctaaaaaatgttttttgttgttgttgttgttttttgtttttttgtttttttaataaaggccaggtgtgatggctcacacttgtaagcctagcactttgagaggccagggcaggaagactgcttgagtccaggagtttaagaccagcctgggcaacatggtgaaaccccatctataaaaaaaatgcaaaaaattagccaggcatgatgacgcacgcctgtagtcccagctactcaggaggctgaggtgggaggatcacgtgagcccaggaggtcgaggctgcagtgatccgtgattgcaccactgcactccaggctgggcaacaaagtaagaccttgtctcaaaaaaataaaataaaataaaaaataaaaaaaagaaaagagaaagaaaaaaagagatatgtggtactgtttttcaaacttcacatttctctaacctgacttttgtgttcaacatgagataaatctgattaataaaaatagtttccatgcatccattttcatgactgcatagtattctgtggtaggagtatgctgccgtgtatttatctatttggattgtttccagctttgggctattttgacccaaagtgtccctgctttctcccaagtgagtttctctagggcacgtacccaggagtggaactgctgagttgtatactgtgtgcatcctcagccccactaggtattgccaaattgctctgcaaagtggttgtgccaattcatgctccctgggggctggcttctgctggctgaggctggcttgaccttgctggcaggaaggagccttaaaaatccctgtgtggttttttttgttttacttttattttaagtttaggggtacaagtgcagatctattacatgggtaaacttgtgtcttgggggtttgttgtacaggttatttcatcacccacgtattaagcctagtacccattagttatttttcttgatcatcttcctcctcccgccctccaccctccaaaaggccccagtgcgtgttgttcacctctgtatgtccatgtgttatcatcatttagcccccacttagaacacgcagtatttggttttctgtttctgcattagtttgctaaggataatggcctccagctccgtccgtgttcctgcaaaggacatgatcttgttctttttcttggctgcatagtattccatggtgtatatgtaccacattttctttatccagtctatcattgatgggcttttgcagccctgtttttttttttttttcataataacacggttatgggaacacttagggaagctcatatattattgagcagtgtgatggttaatattgagcatcaacttgatcagcttgaaggatgcaaagtcttgttcctgggtgtgtctgtgagggtgttgccaaaggagattaacatttgagccggtgaactaggagaggcagactcacccccaatctgtgtgggcaccatctaatcagctgccagtgtggccagaataaaagcaggcagaagaagttggaaagagtagacttgctgagtcttctggccttcatctttgtcctgtgctgaatgcttcctgccctctaaaatcagattccaagttcttcagcttttggactcatggacttacaccaatggttagccaggagctctcaggcctttggccacagactgaaggctgcactgtcagcttccctacttttgaggtttgaggactctgacggatccaccactggcttccttgctcttcatccttcagatgggctatcgtgggactttaccttgtgattgtgtgagtcaattctccttataaactccctttcatatatacatctatcctgttagttttgtccctctgaagaaccttgactaatacagacacctagtgggtcccaataagtgatcattaaactgaaggcagtcattcagtaggtcagtttgtcacttgtgtttgtatctccctgcttacaacaaggtggcctttcttctagtttcctgtcatctgatggaagagattctagactcattcctctagaggagaaatacttcatctagaacagataggtcctaagggtgagagctcatcgttgggatgaatgaacccactgaaattttatgcaagaagaaaattgtgtatatgtatatttttttttctggtctgtagtttttattagattctcagggaatcctgatcctatcatgaagaccttctattctagattgggttcctttcacatccccttctcctttcttgttgaattctccatgcatttctttcacttgcttttcttgctcttatttctctggtagtcagttatcctttttgtctggtggttctatctccttcaaatgaggcacattgctcaaattttattactccaaattccaaggtgctgtttagtgtcctgttgggttgtaagctaggaacagggaggggaaagtaaaacattctgcatgagctgggtgcagcgggcaagcacctggaattccagctactggaagctgaggtgggaggattccctgagcccaagggtttaaggccagcctgggcaacaaagtgagattttgtcttaaaaaaaaaaaaaatcccagctgggctctgtggctcatacctgtaatcccagcactttgggaggcagaggcgggcagatcgcttgaagtcaggagttccagaccagcctggccaacgtggtgaaaccccatctgtactaaaaatacaaaaaaaaaaaaaaaaaagcctggcatggtggtgtggtgtgcactggtaatcccagttatttgggaggctgaggcagcagaatcacttgaatccaggaggcagaggttgcagtgagctgagattgtgccactgcactccatcctggatgacagagtgagactctgtctcaaaaaaaaaaaaaaaaagaaagaaaaaacacgcgcgcacacacacacacatcatgcagacctagccttctgccaatgtcaatggtagagaaacacagtagacacttaattctatgtttcagagaggaggggactcaaatatattaatttgacattgagacagtgatgactttaatgagtactttctttcctttttttttttttttttttcgggacagagtgcagtggtgggattttggctcactgtagcctccacctcctgggttccagcagttctcctgcctcagcctcctgagtagctgggactacaggcatgcactgctgtgcctggctaatttttgtatttttagtagagacggggtttcacactatcagccagactggtctcgaactccggacctcaggtgatctgcccacctcggcctcccaaagtgctgggattacaggcatgagccaccgtgcccggcctaatgagtactttctgattaacctgttgccctctcagattcctgaagcaaaccacagcgttaaaacgtgattcattttgtgtggaccaccacggtgtttaccttcttcttgggtgaagtttggtggaaaagatcttaccccggacatctgtttgttctttgtaactcagagcctcagagaaatcctaactttataatgttgtcaaacccttgtaaggcatgtttttattgtatttgtgttctgatcatgaaactgaaaatgtgtaagaggaagatttcagaagcttggctgtatgtctgagatgacagttcttttactgtcattctcaaatatatataaatattgaagagatcaaataacacaaatcgtgcatgttaagaaaagagactgtgaacctcaccagagaggggtgagcacaattttttttcttttttattcacagggttagcactgtccctttcacataataaatgctcagtaaaataaatggttgttaagccggaaaagggtaacacttctgataatgagtgtcctgggaaatttactaagctgtttagaagatgggaccaacacactgatagaaatagtcagatagtccagaagtctatggcagatgccctgaacatcagatgagatataagacagagaagctctgggtctttgccagctctgacattttatgactctatgaaacggaaggttcctttttagaagggtctataaactgtctcaggctttgggccattttgttgaagatcagaggcaaggaaaagacacaactacacaggaaccatcagggaaagatgttgttttttggtcttgaagcatcattgaatttttttttttttttttgagacggagtttttctcttgttgcccaggctagagtgcaatggcatgatctcggctcactgcaacctccgcctcccaggttcaagtgattctcctgcctcagccttctgagtagctgggattacaggcatgtaccaccaagcccgggtaatttttttgtatgtttagtagagacgaggtttctccatgttggtcaggctagtctccaagtcctgccctcaggtggtccgcccacctctgtctcccaaagtgctgagattacaagcgtgagccaccgcaccgggccgcatcattggattttaaggctccatggattctggcaggtccagcccttctgttttactcacaaacaagtggtttgtccaaagtcacacagagatggtggcaagagatctagaataagaaggtgtcttcaagtcatggagccaggaaccctggctttttgggcaatggaagtggtataaatgtttaatatcacccctcaggttctgccactagagcccagctctctcttccttcctcttgccccctgactagcctatggcctctttccagagaataagaaagggatcctcagagaataatcccagttcctcgctttttattatatagttgaggaaaccaagtctcagaggggtcagtgtcttgaccatacacctctcatgtcctctctcctttttgattaattgaataaatacatgtagttgcttcttacctcctttctttcttcacccctgccccatgcacctgctcttagttgccttcacatgtaaacagcattccaacaacaacaacaaaacacaaccagcattctaactcatgagaccagcaacagttcctataaataccagcagcattttattttaatgtctctctgcagtagtttctcccctccatggatcagtcatccttggtaccaaaaggattccccactgtgacacaaatgctttttgtcattctcagtgagttataccattgagagagcatcgatctttttattgttcaaagcttttggttgtcatgatatttgctggaccatgtttcaccaggaaccacatcacttcctagcagcaggagctattttcttccatcttctaacaacaccagcagtgacagtgataataatgatgttagctgccatggtcgttattcttatcatttattgagtacttactatgtgccagggactacattaagagttttatgtgtattatcacattgagcctcgctagcctttgtacagatgaatctgaggctcagagaggttaagctgctcacaagggagtcacacagctggtaaggggtggatcaggatctcagcctctctgctaggacacttctctaaacctagaataatactgggcctgtgttaagttcagcaaagagctgtattcaacccagtgtccttaggaatgtaatgcctgttattaacaacagtggcaacattgataagctgaaacttatgaggtgcttacaatatgatatactatatattatatacatacataggcacccacctataatctcagcactttaggaggccaagtcaggaggatcacttgagcccaggagttcgagaccagcctgagcagcatagcaagatcctgtctctgtaaaaagtttattttttcagttggccaggtatgttggtacatgcctatagtcccagctaatgaggaggctgaggcaggaggattgcttgagcccaggaatttgaggctgcagtgaactatgatcacaccactgcactccagcctgggtgacagagcaagactgtctctaaaaataaaaataaaaataaaattatttcaactctcaaggttaaataaatactattattattcccatttacagatggagcaactgaggctcaaagacattaaatgcttactgtcttagtctgttttctgttgcttatagcagaacacctgaaactgagtaatttataaagaaaaagcaatttatttcttacagttatggagactggaaagtttaagatcaaggctgcatgagctataatgcacacacactattgcactccaggctgggtgacagggtgagaccccgtgtcaataaataataatataaaataaataaaacaaatttcaacatgagttttggaaggtttgaaatattcaagccagagcatctgtctcataagtggtggacccaggatttgaactaaggcagatctggatctagaacccattttcttgaatcctacgctatttctctaaggtcaagtttgccaaggaaaataaacttgagaatttgaatagagctctctgacatgggaagtcagggtgatccttccttcccctccctgatcttgggttccactatggctgggggaaaacaggagcagaagagatttcaagaaatgagagattggcctagcgccatggttaagacctggacttcagagtcagaggaagctcctccctctatgacagtgagaatgtgggttgaactcactgaacctcagttttctcacctggaaaaagggagtaaaactagtgcctagctcctagggtttgcatcacacacgaaagttggtgaactgaaggaaaaaaacttaaattcttgtgggggagcatgtgatagatgctacaaattctccatgccttatttacctagcttacgtctaagttcacctgcagcttcctcttggtacactcccatctctctacatctctgttggagggcagtctctggcatcacagagtttgctgagccagatgcttaacaacctcggtagcatccctcaaccagtgagctagggagtcagtgtataaataccctggcttccccattgctcagtgggaaaacactgaaatatgttatacagcatcatagaggtgcctcagtaaaattgaatcctagttgttcacataaaacccattcactagtgtaccctttaccaatctctctcttcctcattcctcacttgtaattccttgcattacctcccaaattaaccattggaccctagtttttgccttggggtctactcggcgctaactcaaggagcggaagttggaagcttagcgggttacaggtttcagcaccctggacagctcccagcacaccgtattgtgctaaaatgttctcttccctccctctgcctccagctggggtggagagggactgagtaaaggccagatggccaggtgaccttgttccatactgagcttcttggccattttccctgtggggctggagaagaccttgccatccatctctccgcaggtttgggggccgactgaggtcttgttttctcgaattgctatgacaaatgccagcctgcctccaaggggcatctgtcccactgcctctacagtttgcatgcctaatgactcctctcctctcaccagggcagggaggtggctgcctggtgggccgcttgaagccgggagaccaagatcatgccactggactcgcaacaaaccgagactcttttttttttttttttttcctcgagacagggtcttgctctgttgcccaggctggagtgcagtggcgcgatcttggctcactgcagcctccgcctcccaggttcaagcactcccacctcagcctcccaagtagctgggattacaggcgcacaccaccatgcctggctaatttttgcatttttagtagagagggggtttcaccatgttggccaggctgatctcgaacttctcccctcaggtgatccactcgccttggcctctcaaagtgctgggattgcagctgtgagccaccatgcctggccaacagaataggactctgtctcaaaaaataattttttttaaacattgctttgcaacccagctgcttcttgtgcaggcatctctaaatgaggacagccagtctacatagacacgtaaggaagcatagtggttaagacctggtctttggggttagagtggattcccaacctgactccactgtttccaagctgtgtgaccttgggcaagttactgtacctccctgaatcttccatttcttcatctggaaaatgagagtagtagcatcccctgacttggtggggcatggtggctgatgcttgtaatccaaacactttgggaagccaaggtgggtgaatcgcttaaacttgggagttcaaggccattctgggcaacatggtgaaactccatctctacaaaaacaaaacaaagcaaaaattatctgggtgtgatagtgtgtgcctgtaattccagctactcaggaggctgaggtgggagaatcacttgagcccaggaggtcaagtctgcagtgagccgtgcttgcaccactgcagtccaacagagcgagaccttgtctcaaacaaacaaaacaaaacacaaaacaacaacaaaatactaccaccttatggagttgttttcaaggttcaatgagttaatgtctgacccatgctgggctgggtttatggatgttacttgcccagggacagtctgaagaaagagaaagtgatatagtccattgggcctcagcttcctcatctgtggaatgggaataataattgcacctacctcaaaaggtaaaagtcagtgagatacatataaggcattcagaacaaaaactggcacagaataagtgctcaattatattagctattgtaagactaataactatcattataatgatgataataattattactacttccccaggcccagttccatagaccagttagttaactgtagggaacgtttgctattattagttgggttcccaatatctgacctccctttccaatttagggagaatcctcccctttctataaagtactgctggtctatgggatcccaccctcactaataagttgaaggtgaaagggattcattgtcaccccatcacctggtagtcagggcatgtgatttaaacaaccagggccaggcgcagtggctcacgcctgtaatcccagcactttgggacgccaaggcaggaggatagcttgagccaagcccaggagtttgagaccagactgggcaacatagtgagacccctatctcttaaaaattttttaattagctgggggtggtagcacaggcttgtagtccccgctactcaggaggctgaggcaggaggattgcttgagcccaggaggtcaaggctgcagtgagccgtgatagtgccactacactccagcccagcctgggcaacagggcaagatcctgtctcaaaaaacaaactaataaaaaactcaaccagtcacgttttcctacccaggaatttgaaaatggaccaagtgatccaaacatgatggtttggactctttcatggcctcctgctacaggagaaggtcaggctggctacattgttcctgctgatttcccaaatcccctcttctggccccctgttgattatctgagtttcctaaaaatcccttttatgcctaagatagccggtcagtgtttggttttgcaatcaagaacccagactgggccaggcacggtggcccacgcctgtaatcccagcactttgggaggccgaggcgggcagatcatgagatcaggagatcgagaccatcctggctaacgtggtgaaaccccgtctctactaaaaatacaaaacaaaaaaaaaaaaattagccaggcatgatggcggtcacctgtagtcccagctactggggaggctgaggcaggagaatggcgtgaacccgggaggcggagcttgcagtgagctgagatggcaccactgcactccagcctgggcgacagaacgagactccgtcaaaaaaaaaaaaagaaaaaagaagaacccagaacccagactgatcctgagacaaagatttgagggcaacgaatcacgaggtcaggaaatcgagaccatcctggctaacatggtgaaaccccgtctttattaaaaatacaacaaattagctgagcgtggtggtgggcgcctgtagtcccagctactcgggaggctgaggaaggagaatggcgtgaacctgggaggcggagcttgcaataagccaagatcgcaccactgcactccagcctgggtgacagagcaagactccatctcaaaaaaaaaaaaaaaaaatttgaggacaagtggtttgtttggcaataccaggaaacaggggaacaggatagtcagaaaagaaagagaaagctgggcatggtggctcactcctgtaatctcagcactttgggaggccaaggcaggtggatcacctgaggtcaggagtttgagaccagcctggccaacatggtgaaatcccgtctctgctaaaaatataaaaattagtcgggtgtggtggcgtgcacctataatcaaaataaaataaaatcaggatattttattttaaaactctgtcttagtgtaactcatatttacctcttctgtatgctcctttgcatcagttatatattgccataatacggctgtgtaacaaacaatccccaagacccagtggcttataatgacaagcatttatttagctcatgattctgaagggtggcagtttaggctgggcccagttgggtgctttatctggtctcagttgagctcattcatgcatctttggtcagctgcgggtcagctgggtggctcttctgtttggctgttagctggctgcagactggtccaggatgacctcggctggaatgactgtgctccactccctatggtctttcaccctccagcaggctagcctgagctagttcacatggcagcttttcatcctccagcaggctagcctgagctagttcacgtggcagcaatgggattctaagagaaagaggaagtgttcagccttcttaagggctagtcccaggaatggcacaacatcgtgttggccactgttgtccaaagcaagcaatgaagctggtccagattcaaggaatggggcaacagagcccatctggtatttacctggggccactggggccccattcctgttccctggggccttttgccctgacttctgtgggccctcagagcatattttcagattcctttccatccctgaccctcagcaatcaatgtagatgacgtgtcattactgtgtcacttgcacagagaaaaggaggaaaaaatgtcagcaaaaactctgctgagagcagagggcccatcatacagcaagctggaaagaaaagtgggaatgattacacagcctcctcagatgcttccagcttttatcaaatctcactgtgatatctgagttctgaaccctcacaggtggttggcgtgcaagggaagagatttcttgtctgccatgctgacatgcacagacacgcaacctggctccctctgtccactggggctttggattttgtttgttgaaatgttacccactcctgatcagagctggatggaaacctggctctgattccattggctcaggggctcaggtgggggcagaggccaggctggttgggtgtctatgtggagaccttaactcttctccctcccgccccaactctttttgtttctttttttttttttttttttttttgagatggggtttcactcttgttgcccaggctggagtgcagtggcgtgatcttggctcactgcaacttctgcctcctgggttcaagcaattctcccacctcagcctcctgagtagctgggattacaggagcacgccaccatacctggctaatttttgtatttttagtagagacagggtttcgccatgttggccaggctggtcttgaactcctgacctcaggtgatccaccctcctcagcctcccaaaatgctgggattagaggcgtgagccaccacacctggcccttttcttttcttagctgcctccacctctcttcccttctgcagtgttaggtttatggaaaccgaggccggcgtagagatcaacttcagagagcatgaactgagcatctgctgggtcttagatcctttacatagcttatcatcttcaaaccttctcacagttctgtgtggctagagccaggatttggacacagctctgccccactgtagaaccaggcttccttctgtccactgtcaaattttagagggagaaaatagggaaagggacaccagccttctccacgagcagcttctgcccactcaccccagggactttgcacatgctgtgtgcctgtgtctgagatatgctccctcctctgtatctgcttaattcttacccagacatgatacataaagtatttaacatccaggtggcagggacaccagctaacctgaaaagaggttcccctgttgtgccacatgtgtactcattgtttgctgcattgtgggggcagtccaggggccttgaagaggggccaaggtgccaaaggggcactctcaggcctcaaggaagtacatgtttactgatatgatactgtctcttcctccaggaaggaagccttccctgatctccccactgcatgcccactatgataccagtttaggtcccctctttatggccatctgtggcatcagtgtgaatcctcttaatgttgtctatttggttaatcatctgtctccttcctctggggggtaaagacagaaccacagagcctcgtgtagaacttgagaatggggttcagtaaaaatctgttgaatgcataaatgggtgattgagtgaatgaatgaatgagtgaatgaatgagtgagtggatgaatgaatgagtgaatgaatgagtgagtgaatgaatgaatgagtgaattaatgaatgaattcatagctgataatacaggcttcatggcttttgttaggcttgcccagacattgctaggggatggacagaaggaagaagagctatacttaattccagtcctgttgttctgtagcaggaggagaaaaacagggactgcccagcctgctctgggtggattcaggagcagctgaggttcctctcttatttgcaaacagggaattcaaaaagccccaacctcagaatcacactcgcctcagcagctgtaccagccaaggggacaatgtgggaagccttgggcaccaggaatgctgagtgcttcgaaaaagcgaaggctcagggaacaatccctgatttttcattcccttgtcctttctgaagaaacaggcaaaggcaggccaggcacggtggctcacacctgtaatcccaacactttaggaggccgaggctggtgaatcacttgaggtcaggagttcaagaccagcgtagccaacatcatgaaatcccatctctactaaaaatacaaaaattagctgggtttggtggtgcatccctgtaatctcagctactcgggaggctgaggcatgagaatcacctgaactggggaggtggaggttgcagtgagctgagtctgcgccactgcactccagcctggatgacagagtgagactccatcttaaaacaaaacaaaacaaaaacaagtaaagccttgtgtgtttttaaattgtaggttcagcagcaaagctctgtaataaggagctggaccctgcagtcagacagtcatgggcttctccagtgcccagccgagtgacccgagggagttatgataaacaccaacattcatccacaatttgtacctagtgctattctcaatatcttgagtaaattatctcatttaatcctccaggcacatctttcttggtaggtgccgtcattgtccccagtgtacatctgggaaaatgaggacaggctggcagagcacccttcctgctcacctctgctgctctgctgacctctggcaagactgttgtctctctgagcctcagtttccccatctgaaaattggggcctgtattagcccgttctcacattgctataacgagatgcttggctggggctgggcgtgatggcttatgcttgtaatcccagcactttgggaggctgagttgggcagattgggagtgtgagaccagcttgggcaatatagcaagaccccatctcttctaaaaaaaaaaaaaaattagccaggcatggtgatatgcacctgtaattccagctacccaggaggctgaggcaggagaattgcttgaacccaggaggcagaggttgcagtgagccaagattgcgccactgcactccagcctgggagacagagtgagactccatctcaaaaaacaaattatttttaaaaaattaaaaaaaaaaatgcctggctgggcacagtggctcacacccataatcccagtactttgggaggccaaggtgggaagattgcttgagcccaggagttccagaccagcctgggcaacacagtgaaatcctgtctctactaaaagtacaaaaattagccaggtgtggtggcacgcgcctgtggtcccagctactcaggagggtgaggtgggaggattgcttaagcctgggaggtcaaggctgcagtgagcaatgattatgccactgcactccagcctgggcgacagagtgagaccttgtaaaaataataataataataataaataaataaaaaccctgagactggggtaatttataaagaaaagaggtttaattgactcacgattctgcaggctctacagaaagcatggcagcatctgctcagcttctgggaaggcctcaggaaacttacaatcatggcagaaggtaaagctggagcaggtgtcctcacatggccagaacaggaggaagagagagagtggggagatgctacacacctttaaatgtccaatctcacaagaactcactcacgatctcgagaatagcaccaaggcggaaatctgcccccatgatccaattaccttccaccaggccccacctccaacattggggattacaattcgccataagatttggttgcggacagacacagatccaaagtacattaaaagtaatggcaaaaaccacaattacttttgcaccaacctaatatctcaggggctcattgtacctatttcacaggacaaatgaaggtatcagtaataacagtagcctgtagtcccagctattcaggaggccgagacaggaggatcacttgaacccaggaggtcgaggctgcagtgagctatgatcacgccactgcactgcaccctgggtgacagggcgaaaacttatctctaaaaataataataacaacaacaatagtgaacacagatataacatgtgtgtggccaggctgtgcccttagggctttgcagggattatttcattcactctcaatctccccattttacagatgagaaaactgacgttcagaaaagctagaggacttgccccaagccacacggctaggaagtggtggaattggggtttaaatgaggaagcttgacttcagtgtcgaagctcttaactgccacactcaatacatggagtagaggttgctgattctgtgattatctgattctggaaagtaaagaccctgtttccagacgtttgctgcttgacttagttcccaggggatggccactggatgatgcagtgttgcccaggagaggttagctagacacactgcaaccattccattgctaatacttatacttgctcttgttctgctgggtgctatgcagggaagggctgtctgagccctttgcaagaattctcccattggtgcctcccagagattctgaggttggggctttttgcatcccttattagcagatgagacaccaaagcccaggtcaataatctgacctgcatcccccgcctaccagccagaccaaggtcacttccccacaatgcaggccctgatccaaggctctgggtgcaaaccagtttccatgtccctgggggtccatcttcttcagctgactttttttttttttttttttttttgagacagcgtcttgctttgttgccgaggctggagtgcagtggtgtgatcatggcttattgcagccttgacctcccaggctcaagcaatcctcccacgtcagcctcctgagtagctaggactatgggcacacgccatgatgcctgggtaatttttttttttttttttttgagacagagtctcgcactgtagcccaggctggagtgcagtggcgcaatctcggctcactgcaagccccatctcccaggttcatgccattctcctgcctcagcctctcgagtagctgggattacaggtgcctgctacctcgcctggctaattttttgtatttttagtagagacggggtttcaccgtgttagccaggatggtctccatctcctgacttcgtgatccgcccacctcagcctcccaaagcgctgggattacaggcatgagccagatgcctggctaatttttaagtttttttataaaggcggggtcttgctatgttgcccaagctggtctcaaactcctggcctcaaaaagtcttcctgcctcagcctcccaaagtgctaggattacagacatgagccactgcacccagcctgactttttttctaactgaaaaattaattatatatattcatggagtacaatgggatgttctgatatatgtttacatttttgaatgattaaatcaagccaattaacatatccactacatcgcatacttattttttgtggtgagaacgcttaaaatctactcttttagcaattttgaaatatacaataccttatgttgtatattacattatgttgtatagtacgttgaaacatacactacaatacgttatcattaattgtggtcaccatgctgtgcaaaagatctctaaaacgtattcctcctgtctgactgaaactttgtatcctttgcctaatatctccccaatccctccaccaccagcccctggtaaccaccattctctctgcttccatgggttcaaattttttattttttgaaatttttaatttttatttatttatttatttatttatttatttatttttgagatggagtctcgctctgtcacccagtctggagtgcaatggtgccatcttggctcactgcaacctccgcctcctgggttcaagcgattctccagcctcagcctcccgagtagctggggttacaggtgcttgccaccaggcccggctaatttttgtatttttagtagagacggggtttcaccatgttggctaggctggtctggaactcctgacctccagtgatccacccacctcggcctcccaaagtgctgagattacaagcgttgagccactgcacctggcctaaaatttttttttttttttttttttttgagacggagtctcactctcttgctaggctggagtgcagtggcatgatctcagcccactgcaacctcagcctcccgggttcaagcgattctcctgcctcagcctcctgagtagctgggactagaggtgtgcaccaccacgcccagctaatttttgtatttttagtagggacagggtttcaccatgttggccaggatggtgtcaatctcttgatctcgtgatctgcctgcctcgggcttccaaagtgatgggattatgggccaccacgcccggcctcaaattttttagagctcacatataagcgagattgtgtactatttgcgtttctgtgtctggcttgtttcatcttagtataatgtcctccaggttcatgcacgttgtcgcaaaagatggaatttgctcctttttaaagactgaatagtacttcattgtgtacatatacacgccatattttcttcatccattcctttactgatggacatttgggttgtacctgcatcttggctattgtgaagagtgctgtcatgaacatgggtgtgcagctgactctgaggtgttagagggattacagctcctccaaaagaccaccgtcacccaaacctgctcctcctgccctattttctgtttaggtaaaggcggctttaaccccctgcagtgctctggcctcagacctccagatcttcctctatgcctctatgcctctttttctccaccccctgcatccaatctgttagcacatcttattggctctaccttcagaatctacccagaatccaccacccacctctcaccaccttcacagccccaccccggtccagcccccatctttgctggcctggactaaaccagttgcccctccaccccaatctggtctcttaacttcagtccttgccccacccccaggactgttccccacacagcagccagagggcacctgtgagccactgagtcaggacctggctcctctttgctcacaacctcacttggagaaaaagcccaaattctcctcacagggacccacaaactctgcccctgtgatcccccatccccctctattcccactctcctctccactcactcggcttcagctacacaagttccctgctgtcccttacacaccaagcactccccagcctcagggcctttgcacaggctgttccctctgcctggaacactcttcccccagatatctgcttggctcccccctcacttcctttgggtctttgctcaagtgtccttctaacatgtaactgcctcacctgcactgtgccaccccactccccgcctctaggcttaatttccctctacacccctgaagagcatctgccaagctatatttacttgtttattggttattgccaatcccctgcccccactagaatgccagctccatgagggcagggacttctgtctgttttgttcactgctattcccccagagcctagaacacagcctggcacatagtaagtattcactaaataatttgtaatatgaattgtgccagtaaaatcttccaggggcatcaagcccctgccatgactaggtggtaacatcctcaccccctgtccatgtgctatctcctcctgacctgcttgtctcattgttctaatggtggctcacgcctgtaatcccagcacttggggaggccgaggcgggcagatacctgagttcaggagtttgagaccagcctggccaacatgatgaaaccctgtctctactaaaaatacaaaaattagctgggcgtggcattgcacgcctgtagtcctagctactcgagaggctgaggcaggagaatcgcttgaacccgggaggtggaggttgcagtgagctgagatcatgccattgcaatccagcctgggccacaagagcgaaactctgtctcaaaaaatatatatatatatttcattgtggtaacatatgcataacataaaatgtaccattttttaagtgtttagttgagcggcgttaagtacattcatattgttgtgcaaccaggaccgccatccatctccagaacttttgcatcttgcaaaactgaagctctgcccccaggaaactctcactccccgctcccccttcccctctccccgactcccccttcccccctccccactccccccaccctactccacactccccactcccccagcccctggcacccgccgttctagtttctatctctgtgaatttggctactttgggtcccccctgtgagtagaatcatacagtatttgtctttttgtgactggtttgtttcgtggagcataatgtcctccagtctcatccatattgtagcatgagtcagaatttccttcttttccaggccgaatcgtattccattgtgtggatggaccacactttgcttatctgttcatccagatgggcacttggcttccaccttttggctattgtaaataatgctgctgtaaacctgtgtgtacaaatagctgagtccctgctttcaattcttttggatatagacccagaagtggaattttttttaaatcaagatttgacccactggggcccttagaggtctcattggctctgaagcttttttttttttttttttttggacgctttgaaactaaaaataggagtgaggggcacagtgaggggggcacacatctctcgtgtcagcgttttttaaaaacaccccgggaggaagatgtgtgaaatccctcccttccccccgctcccaccccctccaagatctcaaaatacctcttgttttaggaagcggctgtgacatcaggcaggcagcgtgtggcatctgagacacaatatcgcaagtggctgggagcccagagaaaccaggacaggcgtgctggggatgtggactagagatggagctaattttagtggctgaagaggctgcaagaagagagagaaagaggggtgtgtgtgtgtgtgtgtgtgtgtgtgtgtgtgtgtgtgtacgcacagtgatagaggctggagggggagaaatgacagataaatcagcttgggcaaagaaagctaatgggcagaggagcgagacccagctcagaaggtggtcagcaaatctaaagatgtgtgcccgagggtcaaggtggtggggggattcataggcaagtggtagagaggctattccatttgcagaggctctctctgtttgaggcgtgattcacctgtgccgtcctcaaggccattctgagaacaccactgttgttttcctccttttatgagtagggaaactgaggcattgaactgcttctattcttcagtaagaagcagggggaacatatggtagaagcaaagaaatacaaacatgagggctctcggggtctacgtgattggctgtgacatccatgagagcggatcgcaggttgaaggaaacactggtggcagaaagtagctgaacatttggatttgggaatcccagtggacgtggcgaaaattctggcttttcccttcacaggctgcggggccactctgacctgcggtttccttatctgtgaaatggaacgatgccacctgtctcagcgttgttttgaggatgcgaggagatgatccgtgtaatatgcccactagggggcctgctccagggtagattctcagcaaatggtagtcatggtttttgttacatttggggatattggcaggtaaaaaggaaatacttcattcattccaaaattgctcactgaggttctactatgtgctaggccctgatgacacatcggtcaacaagacaggcctgctttctgcccttgtaaaacttcagttcaactgcattgcactcatcagcctaataatccaggtaaattgtgatgagaataacaactagcatttactatgagccctttacaaatattaacccatttaatcttctaaagagcctataagataagagctcttgccctgcgcagtggctcacgcctataatcccagcacgtcgtgaggccaaggcaggtggatcacctgaggtcaggagttcaagaatagcctgaccaacagggtgaaaccctgtctctgctaataatacaaaaattagccaggcatggtggcaggtgcctgtaatcccagctacttggctgaggtaggagaatcgcttgaacccaggaggcggaggttgcagtgagtcgagatcactccactgcactccaagagtgaaactctgtcacacacacaaaaaaaaacaacctgttattatccacattttacctatgaggaaaccgatgcccagagaggttaagtaactgtccaaaggtcacacagctacggagtggtagagctgggattcagacccaggagtgtgatcccagagtgtgtgtgtatgtttgtttgtttgtttgtttgtttgtttgtttttaccactgtgttttcctgcttctgcaatagaagtaatcaccagtaacactgagcagttgttatgtgccatgcccttaacacacatctccttggatctttggaaagaatcctaaaagggttgtttttcatgatccacattttatggagagagagagatcaaagcatagagagaggaagtaacttgcccaagatcctgcagctgaagactctagggttgcaaatttgggacggccctggaccctgcattccagcttctagcagctcatagggggaactctttatttatttatttatttatttatttatttatttatttattttgagatggagtttcgctcttcttgcccagcctggaatgcaatggcatgatctcggctcactgcaacctccgcctcctgggttcaagtgattctcctgcctcagcctcctgagtagctgagattacaggcatatgccaccacgcctggctaatttaattttttttagtagagacggggtttctccatgttggtcaggctggtctcgaactcctgacctcaggtgatccgcccatctcggccccccaaagtgctaggaatacaggcctgagccaccacgcatgccctgggggggaccacttttatcggtgcatttcttccattttccctgtgtctgtgtaaagataaacacccccaagccccttgactatgaactgtgggccataattagttaatggaaggtaaatgttttagagacggaaattgctgtgccatttttccccgctaggcattgttgcctgcatgctaatgcaacacaatgtgcctttcttctgtcaggcatttttagacaaattctattttccctaaaatattttgccaaagaaaatagcaaatggggaagacattcagaggctcaggcagagagaggacaccattcccttgggtttaaacagaatggcagagtggataacagcacagatcttgagttaggtggatgccaatttgtgatttatttcccagcaaaccaagatgctggctctctgtgtgcctcagtttacttatttgtcaaatgaggagaataatggtacctgtctctcaccagcttaccagttgcctctttagctatgtctaatctgctattaaccacgcccactatgtctttaattccaagtattagaattgttttcttcctacaagctgtctgatcttttttaatcctgcttcatcttttgcagtattgttttcctacagcaggatttctcaaccttggcacaattgacattttgggctaggtaattcttggccgtgagctaccaccctgtgctaagatacttagagcatccctggcctctcaccctactaaatgccagtagcagcccctccccagttgtggcagccaaaaatggctcagacattgccaaacgaaatgtcccatggagggtagaaacgcccccacttgagaattgttctataggtattttcaagcatgtcttacatttctttaagtataatatgcaaaagaaaaggctaaatctaaaaaaagcccataatatgcgaagaatttttataatcagtgtccaataacttaagtatctaaaattgttatggctttttttctgctgtctcttgtttcctgtgattcctcattctggtgccttgttttcttgaatgtcttgttatctttggttgtgtgaagctcattttccatgggacactattttttgttttgttttgttttgagacagagtctcgcttggttgcccaggctggagtgcagtggtgcaatatcagttcactacaacctcagcctcccaggcccaaatgattctcctgcctcagcctcctgagtagctgggattacaggcgtgtgccaccacacccagctaatttttttgtatttttagtagaggcagggtttcaccacgttggccaggctggttttgaactcctgacctcaagtgatcaacccgcctcggccccccaaagtgctgggattacaggtgtgagccaccgtgcccggcatccatgggacactgttgaagggagttcattgaggcctgcgatgaaggcgaaccctccatggacaatttgcatttactttttccaggtgtctgggaaactcccagtctaggaccatcttagacttttagaccaacaatgtgttgagaatttaggtcaccagtgtctgcaaaagccagcttgtggttataatttctcaaaaacttttgtttttctccttttctgcaaagtgccaaagtaacttcctcaaaaatctctgggaatggaaagacgggagtaaattaacttcaggtttcttacctgaaagtgatagcctattggggccccatcctacttggggagtggtgtgtctcctttgagactttctaacacgtgtgtaccctggactttgccccacccctgctccctaggaggccataaaacttgaagcagcagttccatgggttagacagatgcccttggggcaaaagtggttttaatgctctggtagatgctcaggttacctctgggaaattcttgacttcacttatttatttggggctgataactactaattgtcaggcctttcttgtttcaacaacatggacttcagattttatgcaggatttgtcatcgttttcagcaagagagtcagtcttattacccagcttactgcattagaaatagatgtctgggccaggcgcagtggctcacacctgtaatcccagctgtttgggaggctaaggtgggcggatcatgaggtcaggagttcgagaccagcctggccaacatggtaaaaccccatctatactaaagatagaaaaaattagctgggtgtggtggtgcgtgcctgtaatcccagctacttgggaggctgaggcaggagaattgcttgaacccgggaggcagaggttgcagtgagccaagatcgcaccactgcactccagcctgggtgacaggacgagactctgtctcaaaaaaagaaatagatgtctgttgtgtggattatttaaaagagtagatggccaagaactatgacttatgcctgtcatctcagcactttgagaggctaaggtggagggatcacttgaggccatgagttagagaccagcctgggaaacatagcaagacccccatctctgcaaaagtaaaataaaataagttagtgtgcatgatggtgcaggcatacctctagtcctagctactcaggaggctgaggcaggaggatcacttgagcctaggagtttgaggctacagtgatctatgatcatgccactgcactccagcctgggtgacagatcaagaccctgcctctaaaacataaaaataaatacaaattaagttaaaaaataaaataaataagtaatagaacatccagcacagttcttggcatgcattgactgttgttgtttgtttgtttgtttgtttgtgacggagtctcactcttgttgcccaggctggagtgcaatggcatgatcttggctcatcataacttccacctcccaggttcaggtgattctcctacttcagcctcctgagtagctgggattacaggcacgtgccaccactcctagctgttttgttttgtttgtttgtttgttttgtatttttagtagagatggggtttctccaagttggtcaggctggtctcaaactcctgacctcaggcgatctgccagcctcggcctcccaaagtgctgagattacagacgtaagccaccacgcctggccagctgttttgattgttaaatgaaggtggtatgaaagggaaggaagaacagtgacatttgcaagggacactccctggagggcagggcaagggggctgtggaggggagaagtcagagagtatgatacaggttgccttgggtgatgttttagattttagccaacattggcaaagagcctcatttatctctcagagtagctctggctactggaaatgctgcacaacttcaggcggactttctagaagaaaactcttggccaggtgcagtgactcacacctgtaatcccaacactttgggaggctgaggcaggtggatcacttgagctcaagagtttgagaccagactgggcaacgtggcaaaacctcatctctacaaaaaaaaatacaaaaattaaccaggcgtggtggtgcatgcctgtatcccagctacttgggaggctgaggtgggaggattgcttgagcctggggaggtggaggtggtagtgagccaagattgcaccactgcactcccatttgagtgacagagcaagaccttgtctcaaaaaagaaaaaaagaaaagaaaagaaaagaaaattctctctgggattcaatcctggcccacacagcattggcttcacttcacctccttctcccctgagatacacagcaccattcccccaagcttcatcaacttaatctctgatctgggtgctgtgacttgtccccattcctggccagaatttaaggtagggatgaacccactagccctccatcacgcactctgccataaaagcacaccacgtgctgattgctgtctttggtctcctttctgccttgccctctagactctgagctgcttggagacagaggccagttttgtccatctccaaatcccctaaagtcctgtggccagcaagcaggtaggacatctgaaagttcgtcagagagggaattgcttttctcttgagatgcaactagaacaagaatcttattgacctggagtagcttcaaggttgtaagagtatgtgtcagggttctccaagaccactctcaggtttgaaggtttgctaaaagggctcacgggacccagaaaagctgtgaaattcagttatggtttattacagtggaagaatacagataatacagattaaaatctgcaaagcaaaagatgcacaaggcaatgtccaggggagatcaggcatgagcttccagctgttcactcccagtggagttatgcaaacagtgctcaattctcccagcaatggtgtgtgacaatgtacagtgtaccgccaaccagagaagctcacctgagccttggtgtccagggtttttattggggctcagttacattgacatggagcacccatgtgactgactttaactgctgggtctccagcacactccaagatcaaactgataccgtgtgtcccagggccccagctgaacacaaacaggcagtcaccatagatcccattgtgagcataagctaccaggcatggcccaaagccctagatatacagatattctttccaggagccagccaagggccagtccttcctttggaatatgcagagtttgaactccccaaccccaaggagttaactctttactacacagaatataaatctcaccaagtctttcttcttgtcaagtcctctcaaggtgacccattgcttttagcagtgtctttgagaccctgcgtcatctggccttgacccatatcacctgtgttatctctccactctagctacattgaacttttcttttttgagatgtggtctcactccatcacccaggctgaagtgcagtggtacagtcacagctcactgcagcctcaaactcctgggctcaagtgatcctcccacctcagcctcctgagtagctgagcccacaggtgcatgccattacacccagctaatatttttatttttagtaaagatgggttctcactatgtttcccaggttggtctcaaactcctgggctcaagcagtcctcccatcttggcctcccaaagtattggcattacaggggttagccaccacatccagcccattgaactttttaaggatcccctagcatcctatactttctgtcactggatagccttggaattatttttccttctttttgaaatactcttcttctttccaccctttgctgtcaagtctcagaataggcattatttcctccaaaaaccctctcctgaccctccaaatctggatgaggacacttcctttgcccagagagcacctgttttaatcctctcaggtggctataataaaataccttaaactgggtggcttatacacctcagaaatttattttccacagttctggaggctgggaagatcaaggcactgacagatttggtgtctgatgaggggccatttcttgtttcgtagaaggggtcttcctactgcatctttccatggtgaaaagagttgaggcagctctctgaaacctctttcatgagagcatgaatccctctgtcttcatgatctaatcacctcccaaaggccccacttcctaatatcttcacattggtgactaggtttcaacatatgaatttgagaaagacacagacattcagaccatagcagtgctcttccaccaggttttttatccccctgtattataattgaggtttaaattatctgctttccttcccttagattgtaagctccatgagagcagggccctacccatccagtcattgtcctatcccccatgactacaacttcctgggtacataattaatatttattatattatgtagcaaaggtatgctgccatactaagagacccaaaaggccaccggattaaaaccttaaagaaaaaaaaataatttctctcctataatagctgcaaggttagccatgcaggttggcagggaagctcacttccacaaagtcactcagggattcaggctcctgttgccctcttcttttctaccaccaaatgatcttcagcaccatttgcacaatcaaaacttaactggtcttgaataggcagaccttgaatttctgaagtctcagacccaaaagtggcagctgtcacttccactgacatatcactgatggaaacttaatcatgtgatcataccaaactgctagggatgctgggaaatgtagttttgttgggaactccatgacttggctaaaattccattactgtagaagatggtgggggatgggggagtggtggacatccagtggttgctaccatatttattgaatcaaattgtcaaacaggacctatctgataaggggttcttttccagaattaactgaagtattaaatcaggggcaaaggcatgtcacctcatctttctctccctatattggctttctagggctgttataacagagtaacatgaacttggcggcttaaaacaacagaaatttattttctcttagttctggaggctagaagcctaaaatcaaggtgtcagcagagccaccttgacaactgctctaggaaagaattcttccttgcctcttctggtggctcctggcaacccttggtattctttgtctggcatccacttcaatctctgcctccatcttcatttgccttttttctctgtgtgtctatgtcctttcctcttcttagaaggataccagtcattgaatttagggcttactctaaatccaggatgatctcacctcaagatccttaattagttacatctgcaaagagcttatttcaaaacaagattgcattctgaggtttcggtaaacacgaatttgggggaaatagtattcaactcaattcactgctttacttaagaaaagagaccatgaagtgagcctccttctgcttgagagagagagcgagcctttctgtgcaataggtcaatgaatggatgcagctgaattccacataactttataaaaatagatggccagcccatggggtttgctgacccctgcccaaaaattccaaagtcaacagcagtctcttttttaatcatttctctattttttaatttatttttatttttatgttgagatagagtcccgctctgtcgcccaggctggagtgtagtagtctcggctcactgcaacctctaccttccagatacaagtgattctcctgcctcagtctcctgagtggctaggagtacaggtgtccgccaccatacccagctaatttttgtatttttaatagaaacagggtttcaccatgttggccaggctggtctcgaactcctgacctcaagtggtccacccacctcggcctcccaaagtgctgggattacaggcatgagccaccatgcccggccaggattttcttcattttaacagcattcttacttgtcccacatccattctatcctgggtctaattagataacaaaatctacagatcttgtttaactgacattgtcctgggggatactttttatcttttgagacaaggtctcactctgttacccaggctggagtgcagtggcctgataacagctcactgcagcctcgaccacctgggttcaagcgatcctcccacctcagcctccagagtagctggaaccacagatgcatgccaccacacctggctaatttttaaatttcttgtagaggtggggtctccctatgttaccaaaggctggtctcaaactcctgggctcaaaagagcctcccaccttaacctcccaaagtgctgggattacagatatgagccactgtttccagccttggaaatatagtctaagaactgagtcaataggcgattttgtcattgtgtggacatcatgtagagaacttaacacaaacctagatggtataaactactgcacacctcagttatggggcataccctattgcacctaggctgcaaacctgcacagcaggttactgtcttgaatactgtaggcagttgtaacacaatggtaagtatttgtgtatctaaacatatctaggccgggcacggtggctcacgcctgtaattccagatcacctgaggtcaggagttcgagcccagcctggccaacatggcgaaactccttctttactgaaaaatgcaaaaattagccaggtgtggtggcaggcacctgtaatcccagctattcgggaggctgaggcaggagaatcgcttgaacctgggaggtggaggttgcagtgagctgagatcatgccactgcactccagcctgggtgacagagcaaaactccatctcaaaaaaataaaaaataaaaaacatatctaaacagaaaaggtacagtaaaaatacagttataaccatatgggaccaccattgtataggcagtccgctgttgatcaaaacatatcaaaacatcgttatgtagcacatgactgtaccataaaccacacggcttcaaacaagggaaatgtattctctcactgttttggaggccataggtctgaaatcgaggtgtcaccagggtccctccaaaggatccgggggaggatccttccattggatttggagttgcttcactccagtctctgcctcagtggtgacagggcgttctcctcttccctctcaaagttccctcttctgctgtgtcataaggatacatatgactgcatttaggccccactcagaaaatccaggaataaactcttgccctcatattcttaactaaatcgtacctgcataccttattttttctaaataaggtagcattccagggattaggacatcaacataacttctggagggttcactgttcaacccactacagccagaatgcgctttgaattcaggttctgacatctgggactgcctcccacgtacacacaccactaccttgtactgaatgcctgaagggttctgcccccacctccactcccccaaatatttgctgtggacctgagaaagctgacttcatggaagcttcattccattgttctaaggacttttcatacattaacaaatgtcttctctctatggggaaaaccacagagaaatcaagacagagtggggttaagtaactcacctgaggaggaacagtaagtggcagagccaggattcaaaccaacatggttttgcacagttttgacatcatttgcaacacaaatattgtcacagatacctttttgagcatctactgtgctaaccgccaggaaggaaaagaacatggggccgggagagctcttgacaggggacagggctggccatggaggtctgtgtcttggtggaagatgctatggttctctttttttttttttttttttgagatggagtcttgctctgtcacccaggctggagtgcagtagtgcaatcttagctcacagcaacctccacctcccgggttcaagcgattctcctgcctcagcctcccaaatatctgggattataggcacacaccaccacgcccagctaatttttgtatttttagtagagatggggtttcaccatgtgggccaggctggtctcgatctcctgaccttgttgtgatccacccgcctcggtctcccaaagtgctgggattacaggcatgagccaccacactgggcaactatggttctcttttaactccttgtgctgaaattattgcagaagcccaggccagttcatccccagaaagtgaggcataaacaggcagagctctacagaaacagagaatccacgactggtttgatggaggctgcctcactacctacagaatgggctctgggtggattgttctatctggggagccagcccacccaccagtctcagcccttggcgactctttcctgctgtcacagcagctggacattcagaaaccgaaacatgacagccttccctccctgttcctgcccagtggagtggaaacccctcgggacccacataccgagcgtgcacagcagcacagagttgcacagttaacacagcgcttcttctccagccctccggatgcaagctgacagattggcagctggctgacttccaaggtccagtgagttcttggcagtcgctttctgacctggacgagtggctgccacctcctggaacatcaggctgcccccttggggagagggtgacggtctctctggaaagactgtgagctttgaggtggtcatcaaaagccattcttggaaacattctttgagctgtaccgtgcaattcggtcaccaattgcacgtatttggatattaatatccgtatgtggatattaaattggttttgggttttgttttgttttgattgtggcaaaatatacacaacaatcctcctgcctcagcctcccaagtagctacaggcatgcaccaccatacccagctaatttttggattttttaaatttgtttgtttgtttttgttttttgagatggagtgtagcactgttgcctgggctggagtgcagtggcgcgatctcagctcactgccacctccgcctcctggattcaagtgattctcttgcctcagcctcctgagtagctgggattacaggcgcccgccaacacgcccagctaattttttgtatttttagtagagatgaggttttaccatgtcggccaggcttgtctcgaactcctgaccttgtgatccacccgcctcagcctcccaaagtgctgggattacaggtgtgagccaccgcgcccggccgatttttgtagttttagtagagacagggtttcaccatgttggctaggctggtcccgaattcctgatctcaggtgatccaccgcctcggcctcccgaagtgctaggattacaggcatgagccaccgcacacagcctaaatgctgtgcctcacgcctgtaatcccaacactttggtaagctgaggccagaggattgcttgagcccaggagtttgagaccagcctgggcaacataggaagaccccatctctataaaaaataaaaataaattagccaggcgtggtggtgcaggcctgtggtcccagctactcgggaggatgaggcaggaggatcgcttgagcccaagaggtcaaggctgcagtgagctgtgattgtgccactgcactccagcatgggtgaaagagcaagaccttgtctcaaaaaaaattaagcgaaatttaaaattctgtttctcactcacacaggctgcacttcaagtgcttaatcatcccttgtgggtggtggctatcatattggacagcatggatagagaatatttttatcagcgtaggaagcttcatcagagaggaccgctcagaggcctgtggggaccagcacagtgcagtagaagacacaggccagctggtgagagactggtcttctgatcccagatctgtccctcacttgctaggtgaccttggacagctccctcagtccctctggagttttctcttcattgttaaatcaggaaattggcctcagtgaattctgaggccccatctacttttttttttttttttttttttttttttttaattgagacagagtctcgctctgttgaccaggctggagtgcagtggcatgatcttggctcactgtaacctccgcctcccaggttcaagcaattctctgcctcatcctccccagtagctgggactacaggcgtgcaccaccatgcctgggtaatttttgtgttttcagtagagaccgggttttgccatgttggccaggctggtctcaaactcccaaccttgagtgatcctcccgcctcggcctcccaaagtgctgggattacaggtgtgagccaccacgcctggcctcatctagttctaaatgttatgacccactcagctctgaagacaagggaggaacatcctctcagtctagctctgacatgcagaagcctctcaccctgtcccccaggtcataaaggcaggcgtgttgtgaagagcacagaatgggctgagaaaaatatgcagggattgcgtctatctcccttccttccgcacgtttccttgtcggcaccacctgcctctattccgcgccgcacacacacccgccttctctctgtctcggaggaagacaggatcttccatcccccaaatcctgccctgattcctactctgaagcctctgccctgactcctttaagctccctgggaatacagcccatctcctatgccctcctcatcccagtagttcctaccttccccaaaatcgctttgggaaagtcccccaatgagtaaccagctgtcctacatgggcatctcagaacttctcttctgttgttgttgttgtttgttttgcttttgttttgagacaggatctctctttttcacccaggctcgagtgcagaggtgtgatctcagctcactgtagccttgacctcccaggctcaggcgatcctcccccctcagcctctggaatagctgggactacaggcacacgccaccacacccgggcaaattttttttaggacttttggtagaaatggagtttcgccgtgttgcccaggctggtctctaactcctgggctcaagcgatccgcccactttggtctctcaaagtgctgggactacagacatgagccaccacacccggcagagcttctatttcttgagtgtgttctcagccatgctaagacattttctcttctcagcctgatgatgcttttggcttgtgtttctttgtttttaattaccccttcccagtcgctgtcatgggatcatgagggtcttctgtccatctagatgacacctttcttgtgccacgtgtctccaacattccctggtttttaaacccttattgctttcaagatactatccaagctccttaatgtggcacattgtccttcgctgctatctgcctgctttttttttgagacagagcctcgctctattgcctaggctggagtgcagtggcgcaatcacagcttactctgcagcctcgacttcttgggctcaagcaatcctcctgcctcagccttctgagtagctgggaccacaggcatgcaccatcatgcttggctaatttatttttatttatttttatagagaaggagtctccctatgttgcccaggctggtctcaaactcccggactcaaagttcattgcagtttcaattttttccttggctcaaggatcctcccacttcagcctcctgagtagctgggactacagacgggcaccaacacacctggctaatttttgtattttttgtagagatggggtcccactatgttgcccaggcttctatctgcttttatctcaccttccactcttccatccttcctttcttttcttttatttcctttcccttcccttgccttccttttctttctttctttctttctttctttctttctttctttctttctttctttttctttctttctttcttgacagagtctggctctgtcacccagactgaagtgcaatggcaagatcttagctcactgcaacctccacctcctgggttcaagcaattctcctgtctcagcctcccgagtagctgagattacaggtacctggcaccacacccggcaattttttttttttttttagtagagacggggtttcgctatgttggccgggctggtcttgaactcctgacctcaggtgatcctcccacctcagcctcccaaagtgttgggattaacaggtgtgagccactgtgcctggccttttttttttttttttttttttttaagacaggaccttgctctgtcactcaggccagagtgcagtggcactataatcactttctgcagccgtgacctcctgggctcaagggatcctcttgccttggcctccctagtagctgggactacaggcatgtgccaccacactggctaatttttaaaactttttgtaggccgggcacggtggctcacacctgtaatcccagcactttgggaggccaaggcgggcggatcacgaggtcaggagattgagaccatcctggctaacacagtgaaaccccatctctactgaaaatacaaaaaattagccaggtatggtggcgggcgcctgtagtcccagctactcgggaggctgaggcaggagaatggtgtgaacctgggaggcggagcttgcagtgagctgagatcacgccactgcactccagcctgggcgacagagcgcgagacaccatctaaaaaaaaaacaaaaaaaaaaaacaaaaaactttttgtagagatggattcttgctaggttgcccaggctggtctcaagcttctaggctcaagcagtcctcttgcctgtgcctcccaaagccttgggattacaggcgtgagcccccacacctggtcctaacccactttctgaacttccaaccacaccattttgtcctaatatttaagtcacaccataacatgtcccacttcagaaatgcctaccaaagtagtcttcaaatctttttaaatcagtggaccctttctaccaaacaaatgttattttttaaatatttattttagagtaatttagacttttagaaaggttgtagctgggcgcagtggctaacgcctgtaatcccagcactttgggaggccgagacaggtagatcacctgaggttgggcgtttgagaccagcctgggcaacatggtgaaaccccgtctctactgaaaatacgaaattagtcaggtatggtggcacgcgcctgtagtctcagctactcgggaggctgaggcaggagaattgcttgaacccaggaggcggaggttgcagtgagctgagatcgcgccactgcactccagcctgggtgacagagtgagactccatctcaaaaaaaaaaaagaaaagaaaaaaaagaaaggttataaatatattataaagagttcccacatacccttcacccagtttctcctgttgtttgtatcttatattatcaccatatgcttgtcaatgctaaggaattgctgggtgcagagtggcacatggctgcagtcccagatactcaggaggccaaggcaggaggatatcgcttgagcccaggagttcaagtctagcctgggcaacacagtgagacctcttttctgcaaaagaaaacaaataaaacatctaaaaaagaatacactggaggcggcgtggaaacaaggatctcatttgggagttgtctgcaatgttctgagcaagcagtaacggaggcctcaagtcagggctgtggtcatggaggtggggaggggtggttggtttcactatctgtgttgacttaattttagatttgcagactcaactgagtatgaactttaagagaaagagagaggccaggcacggtgggtcacacctgtaatcccagcactttaggaggccaagtggggaaggccgcttgagcccaggagtttgacaccagcctgggcaacatagtgagacccctgtctctacaaaaaaaaatttttaaattagccaggcagggtgatgtgtccctgtaatcccagctactcaggacagtgaagcaggaggatcatttgagcccagaaagttgaggctgtagtgagctgtagttgcaccattgtgcttcagcctgggagacaaagtgagaccctgtctcaaaaaggagaatggggagagagagagagagagagaaggagaaagagagagaaagagagagagggaagtcaaggagaaccccacattttttgacatggtgtattagtctcttctcacactgctaataaagacatacctgagactgggtaatttataaaggaaagaggtttaatgcactcacagttccacatggctggggaggcctcacaaccatggcagaaggcaaaggagaagtaaaggcatgtcttacatggcagcaggcaagagagcttgtgccatttataaaaccatcagatctcatgagacttattcactaccacaagaacagtatgggggaaactgcccccatgattcagttatctccacctggcgccgcccttgacacgtggggattattacaattcaagttgagatttgggtgggaacacagccaaaccctatcacatgggcaagtgaaaggatgggtttgccatcaaataaaatggggaaggagactgactaggtgggcagattaggaactcagctttctatgaagtgcctactgatggatagagatattgtgttggccatctattaggttggtgcaaaagtaattgcggttttgccattaaaagtaatggcaaaggaaataacctttgcaccagcctaataggaattggagtctaaaattcaaaaaaggtaagtcagagctggagatccaaaggcaggagtcagcctcctgtggaggctatttaaggaactgaataagggcatagatgcaggagagcacccaggactgagcccagggcttactctccatcattaaagaggttggggaagatgaggaggagccagcagagaagactgaattggagcaaatcagaagaatgtgggtgctggctgtcatgcaaggaaagtgctaagccatttcaagtatgagggaatgatcaatgatgtccactgatgctgatgtgttgactcaaatgaaaaatgagaatcaaccattggatgtagtggcatggagatctttcgtgacctgagccagagctgcttaggtgaagaggtgaaggcaagaggctactggaaggattactactagctcttttaaagagttctgctgtgaagggtagaggaagagagatggggcatgtgttagctggtgggggaagtggatttcagaggtttgtttcccttaaaaaaaaaaaaaaaaagaaaaaagaataaagaaaaaaaaaaggccaggcacaatgactcacacctgtaatcccagcattttgggaggctgagacctcgggaatttgagactagcctggacaacatagtgagaccccatctctacaaaaaaaatttttttttaattagctgggcatggtggtgcatgcctgtggtcctagctacttgggaggctgaggtgagaggatctcttgagcctgggaggtcgaggctgcagtgagctatgatcacaccactgcactccaggctggacaacagagcaagaccctgtctcaaaaaaaaaagatgggagacctaacagcagattttatgctgataggaataacctattaggggagaaaaacatgaggatgctggaggaagaagagtgtcaggaggacatctcttggtggacgagaggggatggcatttggtgtacaggtggaaggtttcactttagatgacagcacacacagttatctatagaaacaggagaaaatgcactatatgggcatacatgctgggaggtagagagtaaataatagtggtggttgcttgtggaaattctcttctaatgtttttatatttttatggtttatcaaggacaatttatatttttacagtttactgcaaacaacaagttctaatttattcaataattatttgtgggtagaccgagtgcagtggtgcatgcctgtaatcctagcactttgggaagccaaggtgggaggattgcttgaactcctgattcacttctgagcttgaatcaggagttcgagatcagcctaagcaacatggcaaaacactgtctctacacaaaatacaaaaactagccaggtatagtggcatgcacgtagtcccagctattcgggaggctaaaacgggaggatcatttgagccctgaaggtggaggttgcagtgagccaagagcgagccactgcactccagcctgggtgatagaataagaccctgcctcaaaaagaaattcttattcttcttcttcttattattatttgaggagacatttactttgtaccaggcgctgtgctagatgctggagatacagacatcaacaatgacaaggctaagtgcctggcgtatttgtactttgagtctaataaaagacatcacacagacacacaacacacacacacacacacacaggattgtcaaaggatcaaccatttcacatgtcaagatcaggaatgatattggtctactactgccttaccatatctcctaccatgacctcatcttcctcttgccagattttaagtctttatacctcaactcccagaactctcttcgcctcacaccctatcacaatgtcatccgtaccccacggccaatactccatcattcgggaaagcaaagttccaaagcgtcaagattgtatcaatggacctgtctctatggcaacagtcctgaatgagccaagcaaggtaaccctggagatggcgtgaatgagaaagtggcctgttgccacggagacgtgctgaatgggaaggcccccacgagccaggctatgtcacgaagccgaaacagtcagcatgaagtcggtatgtctattttcaactcggaattacaaaaatacattttaatagagctcatgacccatctccttcctcgtccctgcctcccaccccactcttcagccttcatcctacaacacaatcgagcctcaccaggaacccttcaaacccctcaaggacaccttactgttccttcagtacacagtccccttcctgggctgaggtggtattcctttgaccaactactgtctcccctttgggaccaacagtattctcaaaagccatgagcttatgggaagaacattaactacattctttggggcaagaacagttgctcacctgtgaaccagctcagcttgcatctgtgagaatgattgcaatgggtagaccagttctccatcaaagaatggccctagcaccccacacacagtggtataatctgatcatgctggtgtattgaacatataatgttagtgccacatgaaaggaatttgtaaaaggacttagtgcctagaaaggtacctttgaagatcttggaatctctgaaacttacccaggttccttataccctgctcaaagtattcctccatttatttcttcattcattagttcttttgtttcaccacatatatatttttgaaacggggtctcactctgttgcccaggctagagtgcagtggcaagatcgtggctcactgcagcctcaacctccccatctcaagcagtcctcccacctcagcttcctgagtagctgggacaccacaggtacaagccaccacgccaggctaattcttgtaatttttgtagagacggggttttgccatgttgcccagtgtattcgtttgttctcacattgctataaagaactacctgagactgagtagtttataaagaaaagaggtttaattgactcacggctccacaggctgtgcggaaggcatggctgaggaggccacaggaaacttgcaatcatggcggaaaatgaaggggaaacaagcacatcttcacatggtggcaggagagagagagtgagggggggagtgctacaaaaccaggtctcacgagaactcactcactgtcatgagaaaagcaagggggaaatctgctcccaggatccaatcacctcctaccaggtccctcccccaacattggggattacaattcaacatgagatctgggtggggacacagagccaaaccatatcacccaggctggtctctaactcctgagctcaagcaatctgcctgccttggcctcccaaagtgctaggattacagacgtgaaccatatttattaagcattgttacagcaaagagaagcattgttgcagcataacaattggaagactccattgatggacgtctccatcaacaagaactgtcggataaactatggtacacccatcccttagcgtgttatgaagtcattacaaaaagaagaagcagatctctgagtgtcaataagagctagtacttatagggtgtctactgtatacaagtgctgttagaaagtgagtattaactcatttaattcttgtaacaagcctgtgaggtggattctttcatatccccattttacagagaaggaaataggaatctctatatccaagatatgttatcaggtgacaaaagcagtttttgaatggtgccgccattttctcgtaagagcaaatctggaagattccatgagaaattaataattgtgtttgcctctgtagcggcaccctgaaagatttggaagtaggtgtggaaaggaaacttactttcttgtgtctttctgaattttgtactgtctacgcgttttgtctttcacaaaaccaaacagaaaatgaccatttggtgcattttgtgtgtcaggcattcttctagtctagagaagcacaggagagcaaaatattttactgacgagaaaaatgaggcatggagaagttaagtgacttgcccaggtagcagagctgggattccacatcatagggtttatacaggaaacaggtaaacagagctgtgcttgtgtgtgggtatgtgtgtacacatgcatacatgtgtgcatgtgtgtgtgtgtttgtgtgtgtgtgaatgtgcttgtgtgttgggagagggaaatggcaagagaagaacctacagaaggtcagcaggaaccaacccatgttttgaggagtttggactttatcctgaaggcacaagggagccatggaaggatttagacaaggggtggttgtgcttagctttttatttagaaggatgactctggctgaagggtgatggcccagaatacaggtatatgtgaaggactcctcctgccctagtaggaggatgcccacccaccctctctgcccagtgcagtatcaaagggcaaattgggtacagagaattctcaccaagctgggtagaatccactctgatgctggggagtggacactgaatgcaccagcctctcctcctgctcaatccctgaattgaagctgttccactaatgttagggatcagattcccttcatatatatatatatatatatatatatatatatatatatatatatataattttttttttgagacagagtctccctctgtcacccaggctgaagcccattgtcgcgatcttggctcactgcaacctccacctcccaggttcaagcaactcttgttcctcagactcccaagtagctgcgattacaggcacccgccaccacacctggctaattctatatttttagtagagacagggattcacctatgttggccaggctggtcttgagctcctgggctcaagtgatcagtctgcctcagcctcccaaagtgctagtattacaggcatgagccaccatgcccgtcctttttatattacctttttttatagagatgtggtttcactatgttgaccaggcaggtcttaaactcctggcctcaagcgatcctccctcctcagcctcccaaaatgctaggattacaggtgtgagccactgcatctgtccagactctgttctccataaagctggcatatggaaagagggaagaccatccaggcaatatcgaagtcccattggtgctgatgtggctgctgagaccacatgaatggatgcattctgactctgccacctctcagctatgtgaccctgggccagtcagcaagtccctctataactcagttttctcatctgtaaaatggcgtcaacagtagccaaccccagcaaatactgtgaaatatacagaacatcattataatggtgaggatgatagagatgctatgttatcagaatacctgggcttgaaccagctccccttcttgcaagctgtgtgacttggagctgatgcccaaacctctgtgggcctcatttgtttcatctgttcaatggggataataacactcttacttcatacagttatggaggatttattgaaataattgacatacagctcttagaacagtatccggctccttgtaagcgctcaagaaatattacagactgttgataataatgcaatactactaccaataatatggccaggagcaatggctcacacctgtaatcccagcactttaggaggcagaagcaggctgattgcttgagcacgggagttcgaggccagcctgggtaacatagggagactctgtctttacaaaaaataaaaataaaaatacaaataattagccaggtatggtggtgcatacctgtagttccagctacttgggaggctgaggtgggaggattgcttgagcccaggaagttgaggctacagtgagctgtgatcacaccactgcactccagccagggcaacagagtgagaccctatctcaaaaataataataatggccgggcgcgctggctcatacctgtaatcccagcactttgggaggccaaggcgggcagatcacttgaggtcaggagtttgagaccagcctggccaacatggtgaaaccccatctactaaaaacacaaaaattagccgggtgtggtggcggggtgcctgtaatcccagccactcaggaggctgaggcaggagaatcgcttgaacccgggaggtggaagttgcagtgagccgagatcacaccactgcactccagcctaggtgacacagtgagactccatctcaaataataatatgagtaataataataatatcatttttatcatcattcttactaacagtctctcactccttgccctgcagttttgcctgttttcttggaataacactcttccacacctttcccctcagggatggttcacgtttagcatcatgacccacccctggggattagttagctcatttctggaaagcactttggagctgtaggtgctttgcaggctggaaacatcacgggacttgtaccatatttaagcaatgccagattattctgcctggcagggggaggacacagaggatacggccctggtatcttttctccctgcctacctcagctttgctctgaaccattttctgtcctgttcagggcagcctgggccacttgccacttccagctttctcgggagaggatgccttcctgatggcacgcctcttaacacacacctggtgctgttgttgaaaaagcaacaattgactccagcgccagcactgagaggcttgtccttaaaattagcaggagctgttggaaggtcgctgttagctcttttgactggaacacactgttccccaggtggcatgaggctgaatacagtgcagggattggctctgctctcaggtggcctgctccacgctcctgagctccgggtggaagctgtgaccattatttccttaacagaaacatatatagcagcattaactatgaaccttattactgtgtgtgtgtgtgtgtatatgtgtatatatatatatgcacatatgtgcatatgtgtgcctatgaacctgttctgagcactttacaaatgtcaatgtattttatcctcccaacaacccattttataaataagacttgaggcacagagaggttacgttactgccccaagatcacacagctggagagtggtgaggccaagatttgaacatatgtaccattgtaccatatgtaccaactttttttttctttttgggatgcattcttgctctgtcacccaggctggagagcagtggcatgaccacggctcattacaacctcaacctccaggttcaagctatcctcccacctcagcctctcaagtagctaggaccacaggtgcataccaccatgcccagctaatttaaagtttttttttgtttgtttgtttgtttgtttgcagagatggggtctccttatattacccaggctggtctagaactcctaggttcaagcaatccccccacctcggccttccaacatgctgggattacaggcatgagccactgcacccaggtcctccctccttataaaggtcgccaagcacaatcttgtgagcctggccctatccacacccatacgcaacatggtgtgtatttttcaaacaaaaactgaatgaacacctctggtttgggttcccctcacacttgtcccgggtttgttgactctgtgttgtgggcctagacaaagcagtgtctggagctcctagacccagggaccagacagtctgggttcaaatcctggctcttccacttctgcctgagtgctctctctgaacctgtctttctttatctataaaatggagataatttttttaaactcatcacttggtcaaactgctttgagcatgcaaatgagttcatatgtataaacctcttagaatgtcccaggcaaagaacaacacttcactcagatcaacatttatttagcatctactgtgtacccatgactattctaggtgatgaggagaccctctggttcttatgaggtagtgaggtgggggagggtgagaaccctaaacattaacgatggtgtgttcgcaggtgggaaaatcagtaaagtcgggtaaagggaatttgggagtgctgtgctcaagtcctggccctgccactttctggggtgcaagatacagcattgaatagggtggtcagggtaggccttattgggaaagtgatatttgagcagacgatctagatgtcggcacatattgctactgtttgatggtactaatatgagtttgagtttcacttgcaagtatatatatatatatatatatatatatatatatatatatatatgtgtgtgtgtgtgtgtatatatatatgtgtatatatatgtatatatatgtgtgtatatatgtatatatatatgtgtgtatatatgtatatatatgtatatatatgtatatatatgtgtgtatatatatgtgtatatatatgtatatatatatatgaaatttggtccatttatttatgctgatcaattaattgatgttgaaattataattgaatgttttattaataaacagatacccacatactattttttcagaaattgttaggttttggggttttctttagattttgattatttttatttgcttaattttcttttttcttttttttaattttatttttccataagttattggggtacaggtggtatttggttgcatgagtaagttcttcagtggagatttgtgagaacctggtgcacccatcacccgggcagtatacactgcaccatatttgttgtctgttatccagtgctcacctcctactcttccccccaagtctctaaagtccattgtaccattattttactcacccacattctttggcctgagatgctgagtggtcatgactcccagatcccttcttgtttctgtatcaaagatctttactaagatcctggcctagggaacctattccctttcctcatccccaatgggagaaggggcttcttccccagcttatttgccaactcataggaaaggtatgaaggagaggactgtagttgtcttgaagctggtcagatgttgaagagatgataatatttgctgatcaagagagacaaagcaatgctggaagaagaggctgtgttagttaacaccagctgcaataaccaataaaaccaaaaatctctggcttaagagtatgcatgagtgagaaatcaacttctaaagtacaactggtggccggatgtggtggcttatgcctgtaattctagcactttgggaggctgtggtgggagggtcgcttgaccccagtagtttaacgccaacctgggcaacacagtgagacaccatctctactaaaaataaaaaataataaagtgaaactggtgaggggtgcaatgaggtggagtggtgggtgactcaaatatggctcgactccatgcagtcactcagggatccaggctgttggaggctctccctgcttaaacatgtggcttccaaggttgttctaagagcctacattgagacagcagctggggaaaagggaaagtggagtgggaggtacttatgagggttcctggaagtggtgaacaacacttctgcctgcattctattgggtggaatttagtcatgtggcccaggctagctgcatgggaggctgggaaatgtagtctctgattaggctgccatttcccagtcccacttgtgaatctttagtgggaagctcaccatgtttgcaccagggattcagtctacctcccactcatgcctcaactatgtatcaggcactgtcgtaagtactttacatatcagcctacctaatgcaaacaactactcagtgggtgctttattggtcacatgtattagtgagaacatggaaacccagagccgttaaatatcttgcccaaggtcacacagctaggaagtggcagagttggaatttgaatccaggaaatctggctgcagagccccacgcttagtataaattcattgtagtttagaaagaggcagaaggaccctaaaattggcataatccattttttggtccctaaggaactgactgaattgactacttgtaaaagtgagtcctggacaggcaacagtggctcaggtctgtaattccaggactttgggaggctgaggcgggcagatcacctgaggtcaggatttcaagaccagcctggccaacatggcaaaaccctgtctctaaaaaaatagaaaaattagctgggtgtggcggtgggtgcctgtaattccagctactcaggaggctgaggcaggagaatcgtttgaacctgggaggtggaggttgcagtgagcaaagatcacgccactttactccaacttgaatgacagagcaagactctgcctcaggaccgccatggccccctgggttctaggtcagagtttctccgccacagcactgatgactttgggggctgcattattagctccaaaatgggagctatcctgtgcactgcctcaacttacttgatgccagtagcgcccgcgccccagttgtgagaaccaaaaatgtctccacacattgccaaatgtcccctgggaggtgaaatcacccctggttgagagtcactgttctagattgttaaatattatcttacactctagcacaagtccaaggcaaactgacttagaaattaccaaccttgcaaaaaatagaagatttcttaaagtcagtgagcatgatggtggcaagctgctgaaatcacacccccagacattagcagatgggatctggacagtattcatctagttaaaaattgacaaggactgggacactgcaggctcttcaaaagagaatcatttgaataacaaggggtcaagacaggggtaattggtgaaagcccctgctcataatttgaaaatataaataggcatcatgaaaattcatcctgcaaaagtcaaaagtcgaatgtgcagtgttatacatgatcagttgatttgggaggggaaattgcatgcacacacatgagagcttgcacacccacacacacacacctgttcaagtgtgtgtgccagtgctcagtgaggaccatctccccaacctgtctgatcatcttgctttggggtgaccctatgggtgaggcagaaattcttggatcatagttttctaatgaatattataattgttaacttctgatgggtgctgactttttcatctttgcaacactgcgtaggtatttttactctccccattttacagatgagacaactgaggctcagaaagattgattagctctacacgaagccaggatccaggcttagcctggctccaggaatcatgttttgagttacgtagcttccctgattctgagggacctccccacttctgaaatcttctactgttactccccatggccctttcctattgaccggaggcaccccagctcctcactcgtcccttatcttatgaaacatgaccatgatgtctgaattcaaaggagagcctgggctttgtggggaaaacgaagcagaaaaagaaaggtggaggttggtggttgtttttggcatggtgaggagcctgtcgttgcttgaggaaagcaagaaaggagattgctggggcttggatccatctctgggtgcctgtgggtctgtctgtaaaaatgagaactggtcgtgctcattagaggatttgaccgttaggccttgggatagcgatttgggaacttttttctgctaagacaaagaataatatggttcaggttcattttgctcctgctttcccaagccctacatctcttctgggcttttttttttttccttttctctccttcttcttcttcttcttcttcttcttctcatttttggatctggacttctgctgactcatctctctgagcaaggaaggagggaggaagtcagaattgctcattaaccgttttctttagtgactcagctgtgattcacattttaattaatggaggagaaaaacctgatcagtcctaaggcatctgcccaatcacgcataactccaggctggtgataataataatacttgaaaaaagtggggtgtcctgaattaaactatggctcattccccacattagtcttgaggactccaccaggccctctaagttccaggtctcaatggggctccctgaaccagagcagctagtccaagccccgagcagcatttctgcagagttagtctgaggtcaggacaagaaacagaggctcaagccctcctgggatcgcaggaggatcatgggaatgtaatattgtttcctgagctggtctttggctataatcccaggctcaagcctggcctccctcccctcggggcctgaaatttgtcagagcctattgcaggggcagcttctgtgctttttgtttgcccagagaatgagaaaagtccagataatcatgaccgctacttcctgagcacttactatgcatcaggtggtgtgctcagcacttctcatgaatgatcacgttgaatcctcactctgtccacaaaaagaaagagcttttatataattctccaacctccctatgaggaaactgaggcttggcaattgcccaatgtagacaattagtaaataatcaggcaggatataaacccaaccctttcccacctgggagccagagcttgcatctactatacttctctgctttccagtcagctgcaaagaaaaattggaagctgatagctcattcaacaaacacttattgaacccttccacctgctcagccctgttctagacaccagagatccatcagtgaaccaaagaggcaaatccatggtctcatgaaactgacaatttacctgcccaagtgtattagttactgtttataagttcctattaagtgtattagatatgcttgcagctgtaacaaagaatcccaacatgcataagggctcaaaacaataaaaatttcgttcttgcacagataaagttcaaaaggtgtattctttttttttttttcttttgcgacggagttttgctcttatcctccaggcatgagtgcaatggcccagtctcggctcactgcaacctccacctcctgggttcaagcattctcctgactcagcctccccagtagctggaattacaggtgcccgccaccacacctggctaattttttgtatttttagtataggtggggtttcaccatgttggtcaggctggtcttaaactcctgacctcaggtgacccacctgcctcggcctcccaaagtgctgggattacagccgtgagccaccgtgcctggccaaaaaaaaaatgtattcttaaacagcaggcacctctcctctaagcagtaagtcaggggcccaggcttgttccatattgtagctcctcatcttcaacccatggcttccaaagtctccatgcttcttgatatcaagccacagaagggaaaagagcatgagaagggcacaggagaaatgtttctgggacagacccagaagtagtccatatgacttccatctacctcccactggctagagcttacatggcggcacccacttgcagagctgggaaatggagtctaactgagcatccaggaaggagagacagacatgagtctttgcgtgggtcctcactgagaatcaagctccacattttgatcgatgtcaccagagcgtacatggcggcgcccacttgcagagctgggaaacggagtctaactgagcatccaggaaggagagacagacatcagtctctgcgtgggtcctcactgagaatcaagcttcacattttgatctgtgtcacctccttgcaagccctaccttaggacaattttaagggacattcctatcttcttccacccttaggacagttttaagggacactcctgagttcttccacccacctcctctgtttcttgggcttccagctctcaggatttgcctttgccttacaatggggtgaagcaagaatctggaagaatgtctctccccacaatttgaagtcttatttgaaaaaaagcagtagagcatccctccctcttgaggtagggaaatctagaatcaaatcctgcttctccagactttgacctcagaaactggggggacttcaaggtcttcaggtgggcagctttcatgaaccattcattcctcccacctcataccaatcagggtcctaacaggaaaaagaattaacttctagatggttcaaaagaagaccatgccatgaagagactccttaaagagataggaacaggtgagagaaatagataacggctgtttgaggtcctcagagagaagccatcgcgagccctacatttcctggaacccagtggaggcagagctgtgcagaagggactactgtcagaaccagggagggagcagggaagcaatattccaatctctttccctcccctcatcttctgccagcgcttcccctcagccaaaccaaaccggaaacggagcaaagcattctgggagttgtagtcttcaagggtccgcctcgagggcacagagcccgctggagcattgacctagagggcacacagggaatgactagtttgcaccatcatgtgacggactgcacgccctcgattatgtaatccactctataattcaactgcagagctgcatggtacagcaggatagccactagccacacgaggctatttaaatataaatgtacattcattaaaatttaaccaaatgaaaattttagccactgagccccatttcaaatgctcattagccacacgtggctcttggctaccatattggacagatcagaatagaacatttccatcatcccagaaagttctaggggccggcgcagctgtggtgtaacctgagcccatgcatgttatggaatggagaagagagaaaacagcacaagaggcagttttgaagggagacagagagctgtggatcagtagggaggagactctctaggcaaaggagcagttgagaagcaagaaagttgagtgagctgctttgctgcgatggaggcttccctcacggggaagagtagagtcagaaagctttagttcaagttcagctctgaaatgaaccaatgagtgttctgacaagacacctggccttccggaaccttggttttgtagtggccaagggcttgaccctctgaaggttcactgaaaaaaatcaactcacaaggcatattaattggagaaaaggcaggcagatttatttaatgtgtttgcacgagagccttcagaatgaagacccaaagctgcaggggaaattgtccgttttttaagcttaggttcaacaaagtatggacagcggtgtagaaatatgattgaacaaaaagtgtacaatgtaaatgctaatagactgagtggggaaacccaaaaagggctgtcttgattctccttggtctctctgagcatgcatttcttccgggtatgggacaagaccctctctggaatggagggggggctctcttggttctccttggtctctctcagcatgcattccttccgggtatggggcaggaccctctctggaataagggggctgtcttgattcttcttggtctctcagagcatgcattccttctgggtatggggcaggaccctctctggaatgggatccttataacctacggtcaaataacgtaagttagataatttcttttttttttttttcttttttttgagacagagtctgattctgttgcccaggctagagtacagtggcacaatctcggctcactgcagcctctgccttctgggttcaaatgattctcctgcctcagcctcccaagtagctgggactacaggtaagcaccaccatgcccagctaatttttgtattttttagtagagacagggtttcaccatgttggccaggctggtctcaaactgctgacctcaagtgatccaccacctgggcctcccaaagtcctgggatttgtaatcccagcatgagccactgtgcccagccagatcatttctttttctttttctttttcttttctttttttttttttttttgagatggagtctcactctgttgcccaggctggagtgctgtggtgcaaactcagctcactgcagcctctgcctcctgggttcaagcaattctcctgcctcagccttccaagtagctgggactagaggtgcgcgccaccatgcccagctaatttttgtatttttagtagagacagtgttttgccatgttggccaggctggtcttaaactcctgacctcaagtgatccacccacgtcggcctcccaaagtcccgggatttgtaatcccagcatgagctaccacagctggccagataatttttttataactagtttttacaaagaaaggtggagggaaagttagagtaacatttttaggtgttagggctgactttggggaaaagaggtctggtttctacgacccgccttagggaagagggattctagtttttgtggctagccccaggggagaatgggactaagagatagaagggcaggagaaggtcagagaaaaacttttgcttctgtggctgcttcggagaacttcattttggggtattgttttctgagccccaacagtttgcttatcagtgaagtgggtataggcgcccacctcccacagtgacgatgctgtgaacagggctttggaagagtagaactatgaaatatttgttgttgccttgtggggaaatggtcgttaaagccaaaattgttcaagagaagaagcaggaagagttcctttctttcctgcaggtatcctcttaagctgagtcttcagaatcccctgacaacgtttaatcaacactttattaaattcaccccaaccctgcttcaaaccttcacctggtcctcgagatcttccaactgtttcttgatgaagttagcaggcaattgtatggcgggatcatcatctcatgttttgttttgtttttttcctttttaccctctgactttgagaaatccttgtccttttacttttccaaacctgagagcattgcagagaagttagaattgagcaggacatgggcttaagacccagcccagccatgtgctagctgtgtgaactcgaagcagtgaccccacctctctgacctggaaagtagagggaatgataggacccaccaccgccacacttgtagggtcatcatggggattgaataaaataatgcataagacttggcccacagcaagcactcaagaaatgttagctacttcctaaatatatttttaaccttttattgaatataacatacatacagaaaagcacatgtatcatacaagtagagcttgagtgattttcaaaaactgagcccagtcatgtaaccagcgcctagttcaagaaacagaacatagccgagtgaggctgaggcaggagaatcacttgaatctgggaggcagaggttgcagtgagcagagatcatgctatcgctccccagcgtgggcaatgggggcggaggggaagagagagagagagagagagagagagaggaaggagggagggaaggaaggaaggaaggagggagggagggagggaagggaaggaaggggagagagagaaaaggaaagaaaagaggaagacagaaagagagagagaaaggtaaagaaagaaaaggaaagaaagagaaagaaagaaaagaggaagacagagaaagaaagagaaagctaaagaaagaaaaaaaggaaggaaggaaaatagggagggaagaggaggaggaagaagaagaagaagggggggagggagggaacagctgcagcttcgaggaaggaaggagggagggaaggaaggaaggaaaggaaggaaggaaaaaaaaacagcaccaacgtttagaaacccccttgtgcctctgaggtcaccagtaactccatcctgacttcaaacagtctagattagttttgcttgtttttgaactttaagcacatggggtcatacagcatgcatgcattgacttctttcccttgacgttgtatgtgtgagattcatctgtgctgttgctgttcatttgttctcatcgctgtgtgtgctgaaccacctgttcatttactctactaatggtgggcagtttggtgctttctactttggggctattccagagaaagctactttgaacacactcagatatgtctgtgggtgaccactcttcatatttctatgggagatattcctaggaccggaacatctgagtcagagggaggaattggtttagctttggtaggaactgcctaacaattggccgggcacagtggctcatgcctgtaatcccagcactttgggaggctgaggggggcaaatcacttgagctcaggagttcgagaccagcctggccaatgtggcaaaacccctggccaacatggcaaaaccccgtctccgcaaaaaaatacaaagattagccgagcatggtggcgtgtgcctgtaatctcagctactcaggaaactgaggcaggagaattgcttgaacctgggaggcagaggttgcagtgagcagagattgcactactgtactccagcctgggtggcagaatacatgaaactccatctcaaaaagaagaaaggaaggaaggaagggaaggaaggaaaggaaactgcccaacagttttcccaagtgtttgggatggaaggaaggaaggaaggaaggaaaagaaactgcctaacagttttcccaagtggttggaccagttaaaactcccaccacctgtgaatgagagtttgtttttattttgctcctggagtgcctctcctgtagcaggttcccactgaatgtctgggaattcaaatgtaatgcacttgttcatttcctcaagagcttcactccatcaattggattcatccattggctctcccatctccactgacactatgttctcacctctatttggaagacatcctgcctccacctgcccaagtcacattatcttctcattccagcctctcaaggagagttttctctttcaccacctcctctagccctggtgattggcaaggtctcgcaacagtacccttcaaaacactcatgactgtgaatgcactggccttcactaagtttcccattcttctctttctttcttttttcttttcttttctttttttttgaacagagtttcactcttgttgaccaggctcgagtgcagtggcacaaacacagctcactgtagcctcaacctcctgagctcaaggtatcgtcctgcctcagcctccttagtagctgggaccacagacatgcaacgttgtgcccagctgattttcttttttttctttttttttttttttttgagacatggtctcaccctgtcaaccaagtgcagtagcatgatcacagctcactgcagccttgacctcccgggctcatgcgattctcccacctcagcctcccgagtagctggggctacaggcacaagccaccatgcctggctaatttttgtacttcttgtagagaccaggtttcaccatgttgcccaggctggtcttgaactcttgggctcaagcagtcctcctgcctcagcctcccaaaatgctgggattacaggtgtgagccagcacgcccggccatggctaatttcttcatttttggtaaagacaggtctcactttgttgcctaggctggtcttgaactcctggactcaagcaatcctcctgtctcagcctcccaaagtgctaggactaccgatgtgagccaccgcacccggcaatttccccttcttgacttctccagagctctcatccctctcgagctcctgtctcttctagaatcacttacctcaccaccttatggggtttttgcctctgttcctactcctctttatttaagaaaacactgtactttaagagggcttcagaaaccacccgaaatagaaacatgtccttttgttcaatcctttactttaaaagacaaataaaatgaagaattgctctccatgtagaaggttaaggagcttgggaggaccttctgtgagtggggagaactttacattaaaggaaaaaaaatgctggagaatagctgtgaacccaggaagggagaaggacttcctccactgaacttgtaaagcacaaactctaaggcaaaaaaagacatgattacatgaaaactaagatatttgttcaaataaagatgcaattggggccaggtgcggtggctcacgcctgtaatcccagcactttgggaggccgaggcaggcgaatcacgaggtcaggagatcgagaccatcttggtcaacatggtgaaaccccatctctactaaaatacaaaaaattagccaggaatggtgtcacgtgcctgtaatcccagctacttgggaggcttaggcaggggaattgcttgaaccagggaggtggaggttgcagtgagctgaaatcacgccactgcactccagtctagcgacaaagcaagactccgtccaaaaaaaaaagatgcaatagcaggtggttcgggaaccaaaccttacatccagatgctggttgtcccatttcctgtgaatccttgggtgagttatcaacctctctgagcctcagtttcctcgtcaataaaatggagaaaatagtatctacctatggaattgttgtgagttttgaatgagttaatatttataaatcatttagaataggaattagcacatggtaaatagtggatagaatcataaaaaaaaaattgatcaggggttaacttctaactgctgtttgttatagaggtccctagcactgtgtggtcattttaaatttagatgatttagaattaaatgaaatttaaaactcagttcttcattcacactagccacattttaagtgctcaaaacccacaggtgactagtggctaccatatttggcagcacagattgagaacagatttatcatccagaaagttctgtcagacagtgttgatcaaggctacatgagggtctgggtgcagtggctcacacctgtaatcccagtgctttggaaggccaaggtgggaggatcactggaggccaggggtttgagaccagcctgggaaacagagagacctcatctctaccaacattttaagaattagccaggcaaagtgttgcatgcctgtagtcccagctactcaggaggctgagacaggattgcttgagcccaggaatttgaggctgcagtgaactatgagcgcaccgctgcactccagtctgggtgacagagtgagacctgtctctaaacataaaaaataaaaatgtaggtggggcatagtggctcccgcctgtaatcccagcactttgggaagccgagatgggcagattgtgaggtcaggagatcgagaccaccctggctaacatggtaaaaccgcgtccgtactaaaaataaaaaaaaattagccaggcatggtggcgcatgcctgtagtcccagctactcgagaggctgaggcaggagaattgcttgaacctgggaagcagaggttgcagtgagctgagattgcgccactgcactccggcctgggcgacagagcgagactctgtctcaaaataaataaataaataaataataataaagtaaaaataaaaatgcaaagactacctgagggaatgtctgcaagtcaaccagaataacacagcaaccccaataggaaaacaggccgaaaatgtgaacaggcggatcagggaagtgaagtctgaaaagctaatcagcctatgacatggtactcaaagtcatttgtaaccagaaagatggaaatgaaagcagtatctctgtacacctttaatattggggaaaaaatatgtgaataagccaagggtttccagcgatgcgggcacagaggaaagtcttgcaccactcaaaggggtgtggcccagggaggccactctggagacatatcggtagtactcagtccagtgaggtccagcaccatcagcgcttatgtccccaggcatccatcccagggacattcttaccaggtctgttaggggcaggtacgagaatgcttactccagcaccatctatataaggggagctgaaggccacctggtgtccctcctggagaccaggaggcggcatgtgacagcggcacccatggagcaccagaatgagtgagagctccagaccgcatatccgacagatactacgggatggggcttttagaaatatggttgttgccgggcacggtggctcatgcgtgtcatcccagcactctggcaggccaaggcgggtggatcacctgaggtcaggagttcgagaccagcctggccaacatggtgaaaccctgtctctattaaagatacaaaaattagctggacgtggtggcgggtgcctgtaatcccaactactcgggaggctgaggcaagagaatcgcttgaacccaggaggcagaggttgcagtgagccgacatcgtgccactgcactccagcctgggtgacaagagcaaaactctgtctcaaaaaatttaaaaaacaaaaaataaaaatatggttctgggtgaaaacaggaaacaacagaatgtgtctaacttcatcctgcttatgtcagttaaaaatagacacactcaaaatatcgcacgtgtttttgcgagaatgcactcctataaggccaaattaaacattctctcagttgtctctgggagggagaagaatgaaagtagggtatagagagatataggggaattaatgcatgaatgaatgaaggtataaacaagagacaggcgtcatacagaccaaaggtaaagatatcccgtaacctgaggagagcaaagaacttgactctgcatttgaagattcagaaaatgaatttcagaaatagttttctcgccagggggtggctcacgcctgtaaccccaccactttgcgagggcgaggcaggtggatcacttaaggtcaggagttcgagaccagcctggccaacatgatgaaaccctgtctctactaaaaatacaaaaattagccaggcatggtggcatgtgcctgtaatcccagctactcaggaggctgaggcaggaaaatcacttgaacccgggaggcagaggttgcattgagctgagatcacaccattgcactccagcctgggtgacagagcaagactttgtctcaaaaaaaaaaaaaaaaaaaaaaaaaaaagaagaggaagaaatcgttttttcaagaaggggaaagctgggtgatttaagaatgaacttgaagaggatcactcagtcctcaacctaggagtggcaagaatatagactgtatgggaagtggttctgctccttggtacccatcttagaaatatttggcctgagtctgtaagaggcaggtactttatctaacctgaggttagggggccactacatccccatcccctcccctgctttctaaccatgctaacatcttctcactctcctgtctcctctccttctcactcccctaatctgcctattcacattttgggcctgttttcctattggggttgctgtgttattctcactgatttgcagacattcctctgtgtcatctttttaattttgttttaatttttagaggcaggatgtcattctgttgcactggctgtagtgacgtagctcactgcagcctcaaactcttgggctcaaactcctgtcctctgcctccacttctcaactggtaacctcacttctcttcatgaggtctctccagccccagggcctttgcacatgttcccctctcttctgagtggcatatggtagttgctcctctgtaaatatttattgacatcctgacttccaaccagcagagaattgacctccttcccatgctcaggctagtgaaggcatgagtttggctgaggtcccagtggggaaggtgagtggggtggcagagttaaccaggagcagcatggtagaatgggtaaaaccagacgtagcacgcaggcaccacatgttagctggacaagtagtttaaccccatgggtctcaatttccccatcaatgaaagggagaatagaacaagtccctggtaagcagcataaaatgagctctcagaatgtaaagtaacaagcacacaacctggaagagaatacatttagtgaatattggctcctttaatcagcaggttctgatatgacttagctacaattaagaaaataaaaatggaggccgggcgcagtggctcatgcctgtaatcccagcactttgggaggccaagacgggtggggtggatcacctgaggtcaggagtttgagaacaggctggccaacatggtgaaccccatctctactaaaaatacaaaaattagccaggcgtggtggcgcacgcctgtagtcccagctactcgggaggctgaggcaggagaaacatttgaacccaggaggtggaagttgcagtgagcccagattgcaccactgaactccagcctgggcgacagagtgagatttgtctcaaaaacaaaagaagtctggaggccaggaggttggttgcagggttggttccttggctcaacaatgtctccaaagagtccttccatctttccactctaacatcgtcactgtaaggactttttttaacatttaccactcacagccccaagacgactgcgtcagttctttctttttttccttcagacagagtcccgctctgtcgcccaggctggagtgcagtggcatgatctcggctcactgcaacctctgcctcctgggttcaagcgattctcctgtctcagcctcccgagtagctgggattacaggtgcctgccactgcatccggctaattttttgtattttttttagtagagatagggtttcaccatattggtcaggctggtctcaaactcctgacctcaggtgatgcacctgcctcggcctcccaaagggctgggattacaggcgtgagccactgtgcccggccgatgactgcctcagttctaaggtacttacccagccatccacgtagacagacacaaaagcatccggccaaagaagagggagaggaagggctgtctcttaccatgtgactcatctcacggggaaaaaatccttttccagaagcacccagcagatttttcacccagatcctgttaggcctacgaatgggtcatgtgacaagtgctcttattgcaaggaatcttgggaaaaagagactattaggcattttctgcctctttgatgggaggtgggctctgccagtaaggcgggtagtggtggtggctcttggatggacaactgtgtcttccattcttcttcttcttttttttttttttttaagagacaaggtctcactctgttgcccaggcagaaatgcagtggcacaatcacagctcactgctgcctcgacctgccaggctcaggtgatccgcccaccttagcctcacgagcagctggaggagtgtaccaccatggccggctaatttttatattttttgtagagatggggtctctttatgttgcccaggctggtcttgaactcctgagctcaaacaatcctcctgcctcagcctcccaaagtgctgggattacaggcataagccaccacgcctggactctcttctttaaatactgagccttccacctcttctagaatatactctgttaattatcaaccacacttttctacatttttgcttcattattcattcagtaaacatttattgagtgcctactgtatgccaggcacagctttaggtgctggagatgctatgaacaaaacagatgaaaatttctaaaaaataaaataaaaaataaaaataaattttgcaaagccaggcacagtggcttaggcctatagttccacctactcaggagtccaaggcagtaggatctcatgagactgggagtttgagtccagcctgggcagcatactaggactctgtctctaaaaaagaaaagaaggccgggcgcagtggctcacgcctgtaatcccagcactttgggaggccgaggcaggtgaatcgcaaggtcaggagtttgagatcagcctgaccaacatggtgaaaccccgtctctactaaaaatgtaaaaattagccaggcatggtggcaagtgcctgtaatcccagctacttgggaggctgaggcaggagaatcgcttgaacctgggaagcggaggatgcaataagccgagatcgtgccactgcactccagcctgggcaacagaatgagaccctgtctcaaaaaaaaaaaaaaaaagaaagaaagaatagaaaatatctgccctacggggatggacatgctagaacatcaaagtccaatggaactttctgcactgatgaagtatgtatgtatgcaccagccacatgtggcttgggagcacttaaaacgtgactggtacaagcgaatttttcatttaatttaaatgaatttaaatctgtatttaaatagccatgtgtggctagtggttactttattgggcggtgcagctctctaaaggccaagagatacatcatcaacttctctcccttgacccatattcagttctctcccaccctgaaaatctcctctcctacccaggctcacatttccagttcttctcctcttgttctccctcaaccatcagcccccgcaagactgacgtgaccctgatgccgtatgaaatgcattcttcatcctttactcttactcacctctgtgcggccctggagaccagtgacctctcctttctcaaaatactttatttctgtgtgtttttgttgttgctattgtttttggggggttttcttgagatggagtttcactctcatcacctaggctggagtgcagtggtgcgatctcagcttactgcaacctctgcctcccaggttcaagcgattctcctgcctcagcctcccaagtagctgggattacaggctcccgccaccacggctggctaattttcttgtatttttggtagagacggagttttgccatgttggccaggctgatctcgaactcctaacctcaggggatccacctgcctcggcctttcaaagtgctgagattacaggcatgagccaccgcacccagcctcaaaatgcttttgaacttgactgtcaggtatgccattctccacaccagtctcctcccatgtctgtgtcttctccctctccactggggacccttggctttttccacttcactcatctaccctgggttatctggtcttccataaccctgtcctctgccacacctcacttattcacccaccacaatatttattgagtactcactaggccatgaaagatgctatacaaaaaaagcccctgtcctcgtggagctgacattctagaagaaagcatgaataataaatacgacttaataaacagtacggccaggcatggtggctcacgcctatcatccaaacactaagagaccaagatgagaggatcacttgaatccaggagtttgagaccaccttgggaaacgtactgggaccctgtctctacaaaaaaaatattaaaaattagctggatagggtaatgcatgcctgtagttccagctacttgggaggacaaggtggaaggattgcttgagcctgagaggtcaagtccgcagtgagctgtgactgtgcactgcacgccagcctgggtgacagagtgagatcctgtcttaaaaataaataaataaacaaacaaacaaacaatataattccagagagtgaagaggcaggatctctttagctaggaagttgagggatgttctctctgagaaggcagaatctgagtttcaacctgaagaattcgaagaggccagctaggcaaaagatgagagttgaaggaatggggacggcagaggagacagccaatatagtaattctcaataaagcagaaagtgagcttttcctgctggcagaacagaaaggaagtcggagtggccagggtgttgtgggacaaggtggtcagcaggagtcacatcacgcaaggtcatgtggtcatggtagactttaaattttactccaagcctgatggaagccattggaagattttaactaaggagtgacggaaaactggcatctcaaactcaacatgtctacaacccagttcttgatctttgaaaccttcttcctccatcttccccatctccattgacagcaacttcatccttcagttagctcaggccaaaaccctggagtcacccttgatacctctctcctgctccacactcagtctttccattggaagccctaggggctgccatattgttctccatagcacttcacaccgtctgacatactatatcttttcccactattgctttgtccttggtagcatctttaggcactctctgaatatctggcacatagtacgtgctcactaaatccttgttgaataaatgaatgaacatcactccgtggtcctttcagaaccagagccattcttctctttcttcaccaccgttgcccctcaccccgcccaactagtcacaggagttgaaggatgacacagtagagaactgggattctggagtcctgtggctggtctggggttcgagttcttactcagtggtaggaacctccatgtgggattaacttatctggtctttagtttcctcctctgtaaaatgggcctcaaactgccaaccgctgggatgcagggaggatttgatgagcccaggcaggctccctggagcacagcaatcaatggcagctatatataaaccggggcctcttttgtactcccactgcctttgtcctagttccagccctcattacaccagcctgctcttgcggctccctcctaacttctgctccatcaccaccaatctgtcctttcagctgtcaggcttgtcttctgaacgccaaccctaatcacatcccttcctgctccaaaaccttacatgactctcactgtccacaggacaagacccagcctctagttgacagcctccactgtccagcttacccaacctctcccctaccacataccctgagtggagccttctgcctccatagggctttcttagccagagaagcctcccttatcttcctgttctcctcctaattccttcttatccttccagggaggaggctgtgaggtaatgcatcttgggagccagctgggattgcacagggtggtgagattatctgcatttccgaggcttgaacaagttaaggcaatgggaaaggtcacacaatgagaaaatgcagggccaggatttaacccgtctgagatgttctgactgtgctatgctgcctccccggacatgagctctgcgataatgctgtccccaggctgtaatcattccctctttcatccctgcctcctctatccctggggtcagagggacttgtagttgaatctctcactcactcattggtgtggtctctccctaaagcagggtggagtttgtcttagcgttatcactgcatccagcacaacctccctggtccaggcttatcagcgttcaactgcgtcaatgcagttgcctcctcctcaatctcccagcttccggccttgccccctagagagatcatattttaatacaagtcagattacatccctcctcccctcagaaccctccatggctcacaccttactcagagaaaaagccaaagtcctctccacaacccacaaagccctgcaccatccatcacctcactgccttcgtcccctcacaccctcccccttgctcgctctgcttcagccacaccaactcatctctgtttctcaaatacaccaggcatggcctagctattaaatgcacggtccagcctggtgcatttgaagaacacggatgaattggtgtggctggaacagagtgagtgagggggagagcgggaggaggacctttgcaccagctggacctttgcaccggctgttccatttgcctagagttttccctgacatattcatatggctcactctcttgcttcccttgctttctcccagtctttattcaaatgtctatttctctgcacttgtgctgtttgatacagtcaccgctggccacatgtggcctttgagcacttcagttgaaacacatgaaagtgtagaatattgaccagattccaaggaaaaccatgtgcaaaatatcttttatctcttaagatacagggtctcgctctgtcttccagcctggaatgcagtggcacgatcacagctcactgcagcctcaaaatcccaaactcaagtggtcctcccaccaacagcctcccgagtagctgggattacaggcacacaccacaatgccccgcccatttttttaattgttattattttttttaatagcgacaaggtcttgccatgttgctcaggctggtctggaactcctggcctcaagcgatcctcctgcctcagcctcccgagtagctgagattacaggcaggagcttttgtgcccagcaggtctacgatcttcttagaatgcttcaggctgggcatagtggctcatgcctcaaataccagcactttgggaggccaaagcaggcagattgcttgagctcaggagttcgagaccagcctgggcaatatggtaaaaccctgtctctccaaaaaaaatacaaaaattagctgggcttggtggctcccacctgtagtcccagctacttaggaggctgaggaaggaagatcacctgagcccaggaggcggaggttgcagtgagccaagattgagccactgcactccagcctagacaacagggagaccctgtctcaaaataaataaataaataaataaataaataaataaataaataaacaaacaaacaaacaaaccaataaatgaattttacctgtttctttttacttttttaatgtggctactagcaaattttaattttttttttttttttttttttttttgagacagagtcacgctctgtcacccaggctggagtgcagtggtgtgatcttggctcactgcaacctccacctcatgggttcaagcagttcgcctgcctctgcctctgagtagctgggattacagatgcccaccgccacgcccagctaattttttgcatttttagtagagatggagtttcgccatgttggccaggctggtctcgaactcctggcctcaagtgatctgcctgcgtcggcctcccaaagtgctgggattacaggcatgagccaccgcgcctggctataaaatttcataagtagctcttaatagatttctcctgggcagtgctggtctaaacactttttttttttttttttttttttgagacggcatcttgctctgtcaccaggctggagtgcagtggcgcgatctctgctcactgcatcctctgtcacccgggttcaagctattctcctgccttagcctcccaagtagctgggactacagacacccgccaccacgcccagctaatttttgtatttttagtagagacgggttttcaccatattggccaggctggtctcgaactcctgaccttgtgatccgccagccttggcctcccaaagtgctgggattacaggcatgagccaccgcacctggctataaaatttcataagtagctcttaatagatttctcctgggcagtgctggtctaaacactttttttttttttttttttttttgagacggcatcttgctctgtcaccaggctggagtgcagtggcgcgatctctgctcactgcatcctctgtcacccgggttcaagctattctcctgccttagcctcccaagtagctgggactacagacacccgccaccacgcccagctaatttttgtatttttagtagagacgggttttcaccatattggccaggctggtctcgaactcctgaccttgtgatccgccagccttggcctcccaaagtgttgggattacaggtgtgagccaccgcgcccggccctgtaacacttttaacactgaactgtttgccttccaggtggtaaagagcaggtgcctttactgatagaaatgtcaccactcccttcatcccgccagccccatgtcactgacgcgtcctttccccttgctctgtggtaactttctcctaagcactcatcgccctaacatctgtcatacaggtatacctcagagacactgctggtttggttccaggtcgccataacaaagcgaatattgcaataaagggagtcgtgccttttttggtttcccagtgcacataaaagttatgcttacactatagtctgttaagtgcatgatagcattatgtctaaaaaaaaatgtacataccttaattttaaaatccatcaaggctgagcacagtggcttgtaatcccaacactttgggaggccaaggcaggaggattgcttgagcccagggatttgaaaccaggcaacaaagtgagaccccgtttctacaaaaaaattctttttaaaaatagctgggtatggtgacgcatgcctgtggtcccagctacatgagaggctgaggtgggaggctcacttgagcctgagagattgagactgcagtgagctgtgatcacaccactgcactctagcctgggggacagagtgagaccgtatctctcaacaaaaattaaaaaaaaaaaaaaaaaaggctgggcacagtggctcatgcctgtaatcccaacagtttgtgaggccaaggtgggtggatcacttgaggtcaggagttcaaaaccagcccagccaacatggtgaaaccccgtctctatgaaaaatacaaaaaaatagccgggtgtggtggtgcacacctataagcccagctactcgggaggctgaggcacgagaattgcttgaacctgggaggcgggggggagattgcagtgagccgagattgcactgctgcactccagcctgggtgacagactgagactctgtctcaaaaaataaataaataaataaataaataaataaatgttttattactaaaaaagttaacaatcatctgagccttcagtgagtcctcatcttgctggtgaagggtcactggctcagtgttgatgggtgctgactgatcgtgggggtggttgctgaagattggggtgcctgtgacattttcttaaaataagacaagaaagttttccgcatccatcgactcttcctttcacgaaagatttctctagcatgagatgcttgttgacagcaattttacccacagtagaacttttttcaaaattggagtcagttctttcaaaccctgccactgctttgtcaactaagtttatgtcatattctaaatctcatgttgtcattttaacagtgttcacagaattttcaccaggagtagaatccatctcaagaaatcactttctttgctcttccataacaagtaacgcctcatgcattgaagtttgatcatgaggctgcagcaattcagtcacatcttcaggctccacttctaactctagttctcttgctagttccatcacttctgcagtgtcttcctccagtgaagtcttgaactcctcaaagtcatccatgaggatcggaattgacttcctcaaaattcctattaatgttgatattttgacctgttcccacgaatcacaaatgttctttttgttgtttgtttgttgtggattgtttttttatttttaattgagttgaggtctcactatgttgcccagactggtcttgaactcttggcctcaagtgatcctcctgccttgatctccctaagtgctgggattacaggcatgagccactggaacagccacaaatgttcctaatggtatctagaatggtgaatgcttttcagaaagttttcaatttcctttgcccagatgcatcaaaggaatttatctatggcagctatagccttatgaaatgtatcccttaaatcataagacttgaaatagagaattacttcttgatccatgggctacagaatgaatgttgtggctgggcatggtggctcacacctgtaatcccagcactttgggaggctgaggcaggtgggtaacttgaggtcaggagttcaagaccagcctggtcaatatggtgaaaccccatcactactaaaaatacaaaaattagctgggcatggtggcgtatgactgtaatcccagccacttgggaggctgaggcaggagaattgcttgaaccctcttgaagacagaggttgcagtgagccaagatcacaccactgcagcgacagagtgagactctgtctcaaaaaaaaaaaaaaatgttgtgttagaagtcataaaaacaacattcatcttcttgtacatgcccattagaggtcctggataaccagtgcattgtcagcagtaatattttgaaagaaatcttttttctggctgggtacagtggctcgcacctgtaatcccaccactttgggaggccgaggcgtgtggatcacctgaggtcgggagttcaagaccagcctggccaacatggtgaaaccccaactctactaaaaatacaaaaaaattagccaggcatggtagcaggtgcctgtaatcccagctaccctggaggctgaggcaggagaatcgcttgaacctgggagtcagaggttgcagtgagctgaggtcgtgccattgcactccagcctgggcaacaagagtgcgacttcatctaaaatacatatatatatataacatgttatatgtaatataaattatatatataacatatatgtaatataaattatatatcacatataacatatatcatgtgttatatatatcacatataacatatgtgttatatatcacatataacatgtgttatatatcacacataacatatattatgtgtatatatgtcacatatattatgtgttatatatgtcacatataacatattgtgttatatatatcatatataacatatattatgtgtagtgtatcatatgtaacatatattatgtgtagtgtatcatatataacatatattatgtgtagtgtatcatatataacatatgtgtagtgtgttatatataacatatattatgtgttatatatctcatatgttatatataacatatattatgtgttatatattatatatatatttttttctgagtagatctcaacagtgggcttaaaatatcagttatccatgctataaacagacgggctgtcattcagtcttcattgttccatttatagagcacaggcagagtagattcagcataattcttaagaccttaggactttaggaatggtaagtgagcattggtttcaacttaaagtcaccaggagcactagctcctaacaagagagtcagcctgtcctttgaagctttgaagccaggcattgacttctcctctctagctatgaaagtcctagatggcaacttcttccaatagggcatttcatctacattaaaaatctattattcagtgttgccagcttcattaataatctcagctagatcttctggataacttactgcagcttctccatcagcacttatcacttcaccttgcacttttatattatggggacaccttctttccttaaacctcatgaaccaagatcttctagcttcagatttttcttctgcacttccccacctctctcagtcttgctgtgggcttgctgtggattaggctttggcttaagggaatgttgtggctggtttgatcttctatccagaccactaaaactttctccatgtcagcaagaagcctgtcttactttcttatcattcatgtgtttactagagtagcccttttaatttccttcagtaatttttcctttgcattcacaacttggctaacctctagcttatggccttttgtttgtttgtttgttttgtttttgagacagggtctcactccgttgcccaggctggagtgcagtggtgcaatcaccgctcactgcagccttgacttcctgggaccaagtgatcctcccacctcagcctcctaagtagctgagaccacaggtgtgcaccaccacacccagctaatttttttattttctgtagagatagggtctccctattttgcccaagctagtctcaaactcctaggctcaagccatcctctcacctcagcctcccaaaatgctcggattacaggcatgagccaccatccctggccctatctcagcttttgacacgccttcctcactgtgtttaatcatttctagcttttaatttaaagtgagagacgtgcaactcttcttttcacttgagcacttaaaggccattgtacagttatacactgacctaatttcaatattgttatgtctcggggaataggaaggcccaaggaaagcgggagagatggggaaatggccagttggtagagcagtcagaacacacacaatatttatcgatcaagtttgccatcttctatggatgtggttcgtggcacccccaaacaatgactatagtcacatcaaagatcactgatcacagaccaccataacagatgtaataattatgtaaaagtttgaaataccgtaagaattaccagagtgtgacacagagacgcaaagtgagcacacgctgttggaaaaaaaatggccctgatagacctccttgacacagggttgccacaaatcttcaatttgtaagaaacacaatatctacaaattgcaataaagcaaagcacaatgaaatgaagtcttcctcggccggtgtggtggctcacgtccataatcccagcactttgggaggccaaggcaagaggatcccttgagcccaggagttggaggccagcctgggcaacacagggagactccatctctagaacaaaacaaaacaaagcctgcttatatttattgggtttactctcagtctcccccacacagagatagggcctggcttgttattagtgctcagttgatgtttgtgaagtgaaatactaaggacttaaccactgcctgttctttgctgttcatgccctgacagcttttatgtgccagcacagaagaaaacaaggtgcaagaagagaatagtgatctctaagtcagaatttgaggaacccaaattagtaccagaaagctgggaggagaagagaaaaataaagtaaatcaaattaaaagttgaatgggccaagtgcagtagctcatacctataatcccagcactttgggaggctgaggtgagaggatcacttgaggccaggagttctagaccagcctgggcaatatagcaagaccccatctctacaaaaaaaattttttaattttctgaatatgttgttgtacacctgtagtcccagctgcttaggaggcagaggtgggaggatcgcttgagcccaggaggttgaggctgcagtgagctgttgttgcaccactatactcaagcctgggtgacagaataagtccctgtctccaaaaataaaaataaataaattcattttttgtaaagttgtatgtcatggcccctgcctactctggcttcatgacttgctgcttgaacctcaccatccaaatcccagtggtgacaccatgtcatttcttgaatttgccaagccctctttcagtcccaagctctctgtcatggccactctcagcctggaaagttctttccccactggccagatttctccccctcatctatgggaacttgacttgaagtagggggtatcccaggccctggactagttaacacgacctgctgtgtgcccctcaaagccattgtcttcctagctgagaaggcatcacacctgcaacagattcactcattgtgtgcatgtttttcttaaccacttctcttctgcatcagctccatggggcagggatagtctcatatgtcactctacccagcacataggatacgctcagacgcccacttgtggatggtggaaaaggtcagcccaacctaatatgcccatctctcctctaggggtaatcttgagaaaaaaagttgggaacttgctttgtgttagtttaggatgacccagaatagatcctgaaacaagaatttagggcaatccttgtgcaagtagttcatctgagaggtgaccccagaagggttggagaaggagaggggaggtggggcaaggaagggtgagttgtcctgtaggcaactgagctccgtcctactgggagcccacgtggaactcacctcttaagtgatccagaatgaagggtgagggagctgcggtattgatccaccaactcccagcaatctttggttgagggctgctcccttaaagttcattccctgggcctgccccagatttggagacagccctaaggcaagaggtacagataccagttggccacagactgaagtgttaagacccaagcccctggataaaactgaaaaatcaagccagatgtggtggttcccacctgtaatcccagctactcagtaggctaaggcaggaggattgcttgagcccaggagttcaatgctgtagcgagctatgattgcaccactgcattccagcctgggcatcagagcaagaccccatgtctaaaataaaaataaactgaaaaatccccaagttatttgctgtgaccaaccttccattaaccacagaccctctggtattcagcatttcttgtccattatatgaagttctgatgacagtctcttttattgtattgtgccttgaccacgcactgtacatcacttagctctgaaatggacatgttcaggaaacagggccaggtgggaccctgtgtttcaacagcaatacttttacaaatgaggtctcatgacagggtcttgctcggagggtttctatggaagcctcatcccacctactgctatcatccttactaacttgcatttacaaaagggactctttttgaccagaggcttggggtctgtagctgccttctagccagctgatgctggctggtccacacaagcaggatcacacccatttttttgttttcttatttatttctgaataggttagcataccggtaacctgtgtgcctggcattgtgctgaccactttttgtcaacttactgaatcctcacaacccttggaggtattgatactattgttatccaggttatacaaaagggggaaactgaggcacagagcagggatgtcccttgcccaaggttacccaactggaaagtggcagatctgggatctgaacccatgcaggctgggctcttaacactgaactactttcctgccatttgttaaagagccacaaaccaggccaggcaccatggctcacgcctgtaatcccagcactttgggaggccgaggcgggtggatcacctgaggtcaggagttcaagaccagcctggccaacatggtgaaaccctgtctctacaaaaatacaaaaaaaagtacccgggcatgatggcgggtgcgtagtaatcccagctactcgggaggctgaggcaggagaatcccttgaacccgggaggcagaggttgcagtgagctgagatcacaccattggagatcgcactccagcctgggcaacagagtgagactctgtctcaaaaaaataaaataaaataaaataaagagccacaaaccccgaaaggtctgccattcccccagggccccaggccaccccacaatctattgtcattgtaggttgtgaaatatactgaatgtcaccccaaccttgagccatggggaagattccatttctctcattgcaacatttgtgcaacatgaaccatctgttgggggtcttcgtaaatcaccttttatcccgtgaggcaggtactgttaagaccattttacaggtgacaaaactgaggccagtggtgtcgagtcacctgcctgtggtcacccaaccaatacaggacagcttggaatcccaagcacccccgccctgctgtctgacccccaaaacccaccctctgttctccattctggcttctttctttcagcatcttggcgacagttgggacggagtttgacctacggacgctgagggcagttcgagtgctgcggccgctcaagctggtgtctggaatcccaagtgcgtgagtttccgaccctgacaaggggtttgctcacgggccccaggagccctcagtttcccctatgcagagcatctcaggaggccacatcctgccaccagcctgtgtgagggcagtctcttctttgggactccctatagggaaccccctaggaatatgactgtagctccccatgagctcctgaaagcaaactaggagccacacccatttattgagcacctactgtctatcgggagccatgctaagcaccacgtgtgatctcattcagtactcacagccctatgaagttgataggactgatgtctctattttatggagggggaaactgaggctcagagtggctgaaacattggagcagggttttgtggctgagaagtggcagaactaggagtgagcaagtgtgactccaagcctgggccgtaccactggtggcaatgaccattcccatttaatgagtgcctgctgcgtgcagggcactacagaaggactttacatgaattaccttatttcatcctcacagtcacccagcgaacacccattttacagatgagacggttgaggcttaaggaggttaaattactcacctgaattcttagagtggacagtaatgagctctaaaattcatactcattccttgctgctttctcattctccacagatacatctagtccccgtttaagggtggctgccatatgcagggtcaagattaagtgtaggttgagccaaaaaaaaatgtaaaaagcaaaaataaaacagggctgtcctttttctatcttcttgtcttggttaataataataatttagccaggcatggtggctcatgcctgtaattccagcactttgggaggatcacttgaggccacaagttcgagaccagcctgggcaacattgtgaggaacaccacccccacccccccgccaatatctacaaattttttttttttttttagaaattagccaggttgactgggcacagtggctcacacctggaatcccagcactttgggagaccgaagcgggcagatagagcgagctcaggagttttaagaccagcctgggcaacatggcgaaaccctgtctcaaaaaaaaaaaaaaattagcaggcatgatggtgcacacctgtagtcccagctacttaaaaggctgaggcaggaggatctgagcccaggaggtcaaggctgcagtgagctgtgatagcaccactgcactccagcctggacaacagagtgagaccttgtctcaaaaaaacagacaacaaaaagtttaaaaacaaacaatttataggctgggtgcagtggctcatgcctataatcctagcactttgggaggccaaggtggatgggtggatcacctgaggtcaggagttcgagacctgcctggccaaaatggggaaaccccgtctctactaaaaatacaaaacttagccgggcgtggtggcgggcatctataatcccagctactcgggaggctgaggcaggagaatcacttgaacccggggggcggaggttgcagtgagctgaaatcacgccactgcactccagcctggatgaaagagtgaaactccgtctcaaaaaaagaaaaaaaaaaattaaaaagcacttactatgtgccagacattattctaagtatttccatttttttaaagtcctttatcctcccaacaagcctgtgaagtagtctcttttattatcaccattttacattttattggcttcgttcttccggttcattgctacccaggtttaaagagtaagatttcccagaggatcaccagcaggatctttttgtagaaagaagacacttctatccaaggtctctgcaagatcccagcagatgcctgcatcatattaaattaagggccatcccaaatctaatagtcaaaagagccaggtgcagtggctcacacctgtaatcccagcactttgggaggccaaggcaggacgattgcctgaggctaggagttcaacaccagcctgggcaacaaagtgtgaccctgtctcaaaaaatatatgtatattataatagcagtagtaacaagagtctctgtttaatgaccacctatgacttaccaggtacttcactgtgtgtgaactctctcatctaatcgtatgagggaggtactattgcagtccccatttacagatggagaagctgaggtttggaattcactagtaagtggatgactaggtcaggttcccttgaagcggatacttaggtgggtgttcagatgcacctgctttattgggggacggctcttgggagagacagcaggagatcagcagggtggggctggggaatggatagagcagggacgcaatttcagctggagtgtgtgtgacaccagagttgtcctccaatgcatggcaaggatgccggccttttgtacttctatagtcagtcactgtggatgggaggtagagacgcagtagctcccaggtgagatagcttttgatcaccaagggcaattctactaagaagagaggcagctgggaggcattagcaaccaacatccatagcagctggagggcgggtacaccagaaagaaaatgggatcttggccagacaccaagagtatccagcaccttaaccactgcaccacactgcatctgttagcacccacattacattttttttttttttttttttttttgagacggagtctcgctctgtcgcccaggctggagtgcagtggcgagatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagcacccacattacatttttaagcccttggagtggcatggcccctcgagctatcctgacagcttccctctcttactgtggtctccacccatcaagagccatgggaagttcctgcaatcaagaagcaaagcctcaggctatatgtttgaaccttcattttgatcatagactttcctagtagataccatagtggttacaaacataggatgttgtcatcgttcagacctgagttaatagcctcaagaaaaaaatggtagtggaaccaggtatggtgaagtgtgcctgtagtcccacctactcgggaggctgaggcaggaggctcgcttgtgcccaggaggtcaaggctgcagtgagccgtgatcatgccactgtattccagcctgggtgacagagcaagcccatctcaaaaaaaaaaaaaagccaatgataggcagagaaatactaactaaggctcttgctctgtcgccaggctggagtgcagtggtgcaatcacagctcagtacagcctcaacctccccagactcaagcaatcctaccatctcagcctcccaaatagctgggactccaggcacacagcaccatgcccagttaatttttttgtattttgtagagacagggtttcaccacgctgctcaggctggtctcaaactcctgagttcaagtgatccacccgcctcagcctcccaaagtgctgggattacaggtgtgagccaccacgcttggccagctattattattattaacattcttcgagtcttacaacagtggaacttttagtgcaggatgcgaatttcagtattaaccccttcctctcccaaaaggatttgaagcccagagtaattcagccgccatgaatgaaccatttgttagatgagaggctactggaggctgagcttggtaggataagagcttgcatggggtccctgattgatgacaatacccccagatttaggtcttcagatgcccagttgggtgtgtcttctgttccactgtgtcccttcggggactgttccctgccttctttctttttgagatggaatctcgcactttcacccaggctggagtgcaatggcgtgatctcagctcactgcaagctccacctcccgggttcacaccattctcctgcctcagcctcccgagtagccaggactacaggtgcccgccaccacgcccagctaatttttttgtatttttagtagagacggggtttcaccatattagccaggatggtctcgatctcctgacctcgtgatctgcccgcctcggcctcccaaagtgctgggattacaggcgtgagccaccacacctggccccctgccttcttattcaccaccatctttctgaattgggttgctcagaacagagaaagcaacatcagcacatgggcaaacatggggcttcatttcagatggacctgggttcaaatcctagttctgcctttttttttttttttttttttttttgagacagagtcttgctctgtcacccagactggagtacagtggcgtcatcttggctcactgcaacctctgcctcccaagttcaagcaattctccttcctcagcctcccaagtagctgggattacaggcgctggccaccatgcccagataattttttgtatttttagtagagatggggtttcaccatgttggccagacttgtcttgaactcctgacctcgttaatccgctggcctcggcttcccaaagtgctgggattagaggcgtgaaccgccgccgcgccctgcctagttctgccatttctcatgcattctctgggtgaatcacagcatctctgttagccttgcttcccacttctgtaaaatgagagtgactttacatgtatggccacctcaggggcttgtcactagaagccagtgaaataatgttgagtctggttccttggggttgaaattgggaccgccaaccgctttcctacccagagcagcaactagcctatatggcggccttttatgaatgaggaaaagacaccgcctcttggcagaaaaaaaaaattaagaaaatggctccctcttctgggtgcaagttgcccaacacccaggaatatggctccaaaagcaatggactcccacccctttcttgcccaaaagatcatcaaatggaacagcatgtcaaatacctttattaagtactttaaagttggctgggctctgtggctcatgcctgtaatcccagaactttgggaggcagaggctggaagatcgcttgaggtcaggagttcgagaccagcctggataacatagtgagaccctgtctctataaaatatatatatagatttatttgagacagcgtcttgctctgccactcaggctggggcgcagtggcacaatcatagctcactgcagccttaacgatcctcctgcctcagtccctagagtagctaggactacaggcatgcaccatcatgcctggctaattaaaataaataaataaataaatactttaaagttaaaagtgctttttaaaaaataataaggccaggcgtggagactcacgtctgtaatcccagaactttggaagaccgaggcgggtggatcacgaggtcaggagatcgagaccatcctggctaacacggtgaaaccctgtctccactaaaaatatgaaaaattagctgggcctactcgggaggctgaggcaggagaatggcgtaaacctgggaggcggagcttgcagtgagccgagatggcaccactgcactccagcctgggcgatataacaagactctgtctcaaaaaaaataaataaaataaataataataataataggggccaggtatggtggctcacacctataatcctagcactttaggaggctgaggagtttgagtccttggagaccaggggtttcaggccagcctgggcaacatagcaagaccccatctctacaaacaagttttaaaacttagccaggcatggtggtgcatgcctgtagtcctagctattgcagggactgaggcaggaggatcacctgagcccaggaggttgaggctgcagtgagctgtgattgtgccactgcactccagcctgggcagcagtgcaaaaccctgtctcaaaggaaaaaaaaaacctaggaagtgttgttcccatgataaggatcagcctccgtgtggtgcttccttcaccattgcccaatccccaggctcctgggtgcttaatattccctcaggaacacacctgctttgtctgggagagacctgggcgtcttggtggcggggtttgggggtacttgctcatgggcttatggggcctctctctgtgtccccccaggtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacaggtaggtccacggagcatgatgcatctttccagttttctccttcagggacaagctcttgggaggattaggcaggggtgtgcttctttctcctggcagctgggaggaccgtctccttcagagagcactacaggagaggcagtgagtgaaatagcctctgagatcttagctgttgaaaggggtggggttccacagaaggtgacccagcagagaaagagtttatttgggaatgatcccaggaagcaccatcgggggaatgaggaagtgagcagagaaagaagggatcttttaaagagtgtgctatcaagcgggttaccacttaaaactgggactggatccccctgggcacctctgggagacagcaaagaacacacaactcagctggtcacggtggctcacgcctgtaatcccagcactttggggggccaaggcgggtggatcacctgagatcaggagtcagagaccatcctggccaacatggtgaaaccccatctgtactaaaaaatacaaaaattagctgggtgtggtggcaggcacctgtagtcccaattactcaggaggctgaggcaggagaatcacttgaacccgggaggcagaagttgcagtgagccaagatcacaccactgcactccagcctggcgaaagagtgagactccatctcaaataaataaataaataaaaatataaataaaaaaagaacacacacctcagagccgtcccagccaaggggcaagggagctggggtatttatacactggcttctttttgacattggtgaggactgctcctagagtgggaattaatgcctggcacatctggctgagtggaacaggtattctgggtgctttcagacctcgaccagtcctgacttctaaagcaagcaagaagtggggagagttgggccagaaaagggttattgcctcaatgcattgtgagtggtaccttgtggaaggtgagagacagagaagattccaggcacaggtgccatgctaaacgatagttctcatttattataggaacccatggatttattttgttctctgccctgagtgctgggtgagagtactggatgagtcctcctggtctcccccaacccccaggatgtaccagagataccccaattgggagtcctggcaccaaccaatcagaacctagcactcagcagcattctgcccctccctgactatgcccacattaacccttcagtggctgggtctgggggtagggtgagccccggaaaagccaggcagcgcagagacactctcccagggctcagctctgaaccagcagtgtggaagcagtgtgtccaccacgatccacactcaggaaccaaatagcccttggatacgttttcagttaaatctttgccatccaaactctagctgcttgctctctaaagctccagaatgaaatggaatcaagtaggaagggatgccttcagtatttcagtatttggaccactggccatctgggtgcagacagactgaatagcagttctggttctgatgatttgggtcaagggagctgtgaattgaaggagtggatagaaggaatcaagaagcccaaaggggaacccaggtgggcagagaaagaggtttcaggccccttatttgggaaaggcagccacagaagaagattctgtctgggagtggatttccacccaccctctccacccagtgacccccaagtggatccgcagaggcagcccctgagccctccctccccactcctccccacggggagggaaaacccactggggaaggtttatttgcaatggttggaggtttgggtttttttgtgggttttggtttgttggttttttttttcctctttttctcttgctcctcctgtctctttctctcctgggcttgtgaagtttgctcaatatggaatgtcctaattatttctttccccgatgaagaaggtgttaattgaggcagagctatttctgctcctggcctcgtcacccaggcggaaatgcgagagagagagagagagagagagagaatgaatatggggcagggcctcttggaaaaatcagccgtgagcagagaaaccaggactcctggatcctaggtttctgtgaagttttattttatgtttttctaccctagactagctaaaggagaagaggccatggggttggcttgggtccgagtggggttttgaggggacagatgtgggtggtgccaccagaggggaggaagcctcgatttaggagaaagactgaaaagctagctcacgattaaaaatataagacgtgtgagtaagagacagatatatacagacacccaggcagtgggttaattttaaaatgtatttataaccgaattcctcagacactctggacgcttgtttttctagaagcaacgctcagagtgtttcgtgtcggtggttggggggttgagggggattgcaaagctgctaaagatagacccgttttcagtagcattcctcagtgtcgggagcccagttcctgtgtgcccagcaccgtgccaatcgcttagaaggaagcaaagataaagtggaaggcttcctgctttctaagagcttccaaaatagttagaggaaacaagacccctcatttgcagccatttttaacagtgaaggctaatgtgtgattatacccacgcccccctaaatatgaaaattcagtagctattgtatgcctgaaaggggccaggtgcagtggctcacacctgtaatcccagcactttgagaggctgaggtgggagtatcccttgaggccgttagtttgagaccagcctaggcaacatagccagaccctgtctctgctaaaataaaaatttaaaaattggccgggtgcagtggctcacgcctgtaatcccagcactttgggaggccgaggcaggcggatcaaaaggtcaggagttcaagaccagcctggccaacatagtgaaaccccgtctctactaaaaatacaaaaaaaataaattagccgggcatggtggcgtgtgcctgtagtaccacatacttgagaggctgaggcaggagaatcacttgaacctgggacatagaggttacagtgagccgagatcacgctactgcactccagcttgggcaacagagtgagattttgtctcaaaataaaaaaatttaaaaattagccatgagtggtggtacatgcctatagtcctagctactcaggaggctgaggaagaaggatcacttgagcccaggaattggaggctgcaaggctgcagtaagctatgatggtgcccgcactccagcctgggtgacaaagtgagaccctgtctcaaaaaaaaaaaaaaaaagagagagaggaaggaaagaaggaaggaagggagggagggagggactggggctgtgttaactgggctacacaaagaggctacatggagggtgggaattgagccagacttggacatggcgtggagacagagaagattccaggcacaggtgccatgctaaacgatagttctcatttattataggaacccatggatttattttgttctctgccctgagccttatgtttaaaagatttttgccttccaacctgtatttatcaaataatagttcatgtaccaagtccagcataagtgaggaaggcgtttccaacaacttaagttcatggcgaggctagacttggagtttctattcagccagagcttgaaaggccaacaagattcattcattcagcattggtttatttccctctgctgtgtgctcagtcaagggagcagagaattggtgctgcgaagtctgtagcacatacattgagagatatttttgttgagtaggaagcttgagtttacacacactcagctgtttgttttcttgtccgacaatgccacggtcgtctttgaaaaccttcaaaagcatcgctcacagaataaggtcctctcagacccgctgtgctggtaaaatgaggacactcccagatgtgagctttcctgcctccctaccccatcaataccttaagatttggactgacctttagcgttcagcctgactgccacctccccaggaagctgtctttggtttccagcaaaaggggtgtctgttggcacgtttctctctccttgtggcattttcacagcctgcctcctgctatttggggagaaagctcagctcctgttccttacccttaggcaagggtaggaactgtgtgtactggtgtccctcacccccagaacagctccctgagcccagtacatcccaagaagaaaaaaatcagcaaggcttataggagaataacacaatgcgcttgacaaatttgtcctaatggatgtcggaagaaggctgcacttaccagctacaccatgcacacggcacatttactaaaactgactatattatggaccataaagtttgtctcaacagaggtcaaaaagctgaaaaaaatacaaatacaaaacatattttctgaccgtaatgcaattaagctggaaatcagtaacaaaaagagaactctaaaagtgtttgcagattaacagacatgcctctcatttatggatgaaatgatatgatgtctgagctttgctttaaaaatattctaggctgggtgcagtggctcacgcctgtaatcccagcactttggaggccgaggcgggcggatcacttgaggtcaggagttcgagaccagcctggccaacatggtgaaaccccatctccactaaaaatacaaagattatccaggtgtggtggtggccacctataatcccagctacttgggagcctgaggcaggagaatcccttgaacctgggagtcggagattgtagtgaggtgagatcatgccattgcactccagcctgggtgacagaatgagactccgtctcaaaaaaaaaaaaaaaaaaaaattctagtggcaaggcaaagtgtttggaggggatacagaggaatagatgaaacaaaatttgccagaagtaaataggtaagtgtctaaattggtgataggtacatggtgaatcattatattgttttatacttctctctcgctctctctctccccccgttctctccctgtcttcctctcccctctgtcttcatatatatatatatatatatacacacacacacacacagacacctaataagtttttttaaaaaacaaatacatctaaattacccataggtcaaagaagaaataataatggaaattagaaaatattttacttgaacaataatgataatgcatgacaaaatgttgagatgcaggtaaagccacacttaaaggcaatttatagccttaaaggcagttaatccatccatctcaaaagtttaggaaaagaatagaaaaaaaaaaaaaactcatggaaaacataaagagaaaagtagtaaagctcagagaagaaattaatcaatagaaaaccaataatagacccccaaagccaaacattgatctctttgaagactgatcacgtttgtcccaaaagttattcgttccaacagcattatagagtcactggtccctatttctcagagctggttttccctgctccttcccctgacttttctccccttcccttttgtagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatgtaagtgatgctgggacagtgtgtgtggacaatcagagtctcagggaggtggcctcctgggaccagtgagactccaaggctgcaatggagggaccctgagctgggaaaggcagcccaaggacaacacagccccactgaagctggcctgaggctcaggcttttgaagattacaggggctcatgagcagaactctaactatagggcatagaagtctggagggcccccagatgcaacatcatttttcattgtgcaagtgtttagatataattttagatttttgaatacggaaaggttatgtgatccaaaaaccaacacagataaaagatagagtaatatctttggacgtaggcgaggggtccctgccctgaggctcacccagtccttctccagccataccactccccgtgggatgagaagttcctggagccaaggggatgtgtctaccaagagcttgtgccccactttgtaggccatgttttaagttaccaggatcctggaattccctgcccatggccagattccatgaacttgcgtgcaattctcatatggatctgttcgtaacccaactgagggccaaggacatccgaggggtggctgttaacacaaatgtggccagagcttggatgtacaagctggaatgcccacacatatgtgtggagcccctctggcaggacagagccatgactaagaagagaaagggacaggacagggctggctctccccacaccttgacccagtgcagatatccggattctaaattccaccctgaccttccaaagtgtaaaggaaggtatatttgcaaagtagaagcacacagcatgttttatttagttaccttttcaatatttccccgtagtatgtggtctgcttttgtactcttgccctagatcttaaaaatgttagggatgtttctggaaagatgtatccctgcccccacttgcatgctacttcctcttcccacaatatgcaacccctttagttcctcagaatatccttccaatgtttatttatgcaattataattataagcataatcgaatctatgtcctcccccctctttcttatcccaaggagtagcattctatacatgctgttcaattctgtgatttttgttttctcataaccacacgttctagagatctttccactgcaggacatggacagtctcttcacgggtgcacactagtatgcccagctaatttttgtagagacagggttcttccgtgttgcccaggcaggtctggaactcctgggctcaagcaatcctcccgcctctgcctcccaaagtgctgggattacaggcgtgagccaccacgcctggccttctttattcttttgcacagctgcatagcattctattgtgtggctgcccatagttttatttgtttgccattaagagaaatgcttgactggcttcctgtccactgacatggaacatgatgctgctctgccaggagcatgttgcacgtacctcttcatacttttgcagatatagctagggggttggagggtctccattcccagaagtgggattgcaggatcaaagactaaatgcatttataattttatttttggggaagatttttgttttgtttttttggagacaaggtctccctctgtcgtccaggctggagcgcagtggtgtaatcatagctcactgcagccttaaactcctgggctcaggtgatcctcccaccccagcctcctgagtagctgggaccacaggcacacaccaccatacctagctaatttttaagaacaattttatagagatggggtctcactatgtttcccaggctgctctcagactcctggcctcaagcaatcctcctgcctcagcctcccaaagtgctaggattacaggtgtgagccactgcacccagcctaaatgcatttataattttgatagatatttaggtgtgcaagttttaaaccccactctgtcctcaccacagttcaccttccctcacctactatgcaggtaagcagtccccaggcaggtcacttgtcagcagctggagtggggcagagccaaggattcaggatcaaacacaaggatgccacaactgtagtgaccccatagagcaccctggggctgctccatacacacagctctgttgaccagtggaggtctcctcttcacctgccctaagggctgaaattaccattgaagtttaggccagcggttggcctgacccgggagcaatacctggcttcctcctcctgtacatagagaagctgaactttcctcttggtcctagtgtatgttccttaacaacccatttatgcctagtgttccattattggaatgctaatcctgtgggagttatttacatcctgctgctcaaggtcatcactaaggtcggatttttcacacacacaaaaattgcaacctccggcataaatgggttaaggaatttccccacttgtgggtggagggagatttgcaaaaactcatccttgtaatcctgatcaacaaaggcccgttttagttgggagtaggcagcaaaaggagccacatgaacagttgcgcctgtcacgcactgcacaagaatgtcattcatatcatagacaacatacgatttctactgttatcctgataatttattgacagaaaaaaggatgtggggaagggacatggtgttctaatttgcatgaaaacctcgtctgagtgtagcatctctgggaacatgcagcagatccgagctcaggccctctcttggccgtcacctgcaaacagcttggacaaagggtcagcccaattggccaaaactcactggggaatttttgtgggttctaggtttttactttgcaaggctggtgtgagaggaggttccagcaggaaatgaaccctcctgagagggaaagagactgggaaatggagaaggctgggaactcagggagagaatgggagtggggaatgggagctgaaaaaaattgtgagcataaaaaagggatatgtcacagggttggatgaccagagaaagcgtctgggggttcagattaagatgctgggggcgtgcccagtggtgggacaggaagcatgaatttccagagggctcggttataaacatcattgtccaatgggtgtttcccttggaagcctctaagcttagagctaagccacctctggggacacaaactgagtggttaagagcagagactcaggtgtcagcctgtctgggttccttccgactcttccacttccttgctgtgcagccttcggcaaggtgcttggcctctctgtgccactatttccacatgtgcaaaacgaagagaagcatagtcccacctcacaaggcacgaggactaagtaaggtggattcgcatgaagtgtttagaactgatcctggcccggggtgacctccgtgtaagtcaaattccccaccctgcatggtgttccttttagaaatgtgcatgaatttttcattagaacagctccagcagtgcctgaggaagtggagtgaggtgtgagaggtcttactttattcccctcgctggccctgctattaaccactaactcagagtagctttctagcactttccacacatttacatcccaccctcgtcctttggttagcagcccatgcaatgatttggccttaatgtgaacctagaacacagcttctcgcccagggatgatttctgcccccaggggacacttggcagtggctgcagacatttttggttgtcacaactggatgggaagaaggaggatgctattggcatcaagtgggtaaaggccacggatgctactcaacattctacaatgcacagcatcccccacctctgccccaccatagagaatgatccaggcccaaatgtcagtaaggtttctgtcaggaaaccctgggtcagaagaccaaggttccttgaggacggggatgccttatactgcaatcagctgtcactctctgcctctctctggggctgctgtgatcacctggcctgcatggacaacccctaggagcagcccccatccagtgcctggagaagtcagtggataaataccccagctccctccctgtcgggcgttttgctctgccctgcatctctccagtgggatcaggctctggttgcccgcagggttaacctggtcacgtacacacccttcacttgccaccttcccttccctgtctggtatttcctgggatgaacttttagatttatttcctggggctgctataatgaagcaccacagactgagtagcttaaaacaacaggaatttatggtctgacagttctggaagccagaagtccaaccccaagatgttagcagagctgacaacacgcccctcaaaagcctccgggggaggatccttctttgcttcttcctggcttttgctggtttcccacaatctttgggattccttggcttctagagccttcattctccattccagtcttctgtcatctaatagcatcctcccagcccgggcacagtggctcacgcctgtaatcccagcactttgggaggccgaggcaggcagatcacttgaggtcaggagtttgagaccagcctggccaacatggtgaaaccccatctctactaaagatacaaaaattagccaggcgtggtgggcgggtgcctgtaatcccagccacttgggaggctgaggcaggagaatcacttgaacccgggagatggaggttgcagtgagccaagatcatgccactgcactccagcctgggtgacagaatgagactccgtctcaaaaaaaaaaaaaaaaaaaaaaagaaaaagaaaagcatcctcccttcgtgtgtctgtgtgtgttctcctcttcttagaaggacatcagttgtattggatcagaacctaccctactccagtccaacctaattttaactaattacgtctgcaattaccctatttccaaataagatcacattctgaggtaccagggggttaggacttaaacatttttgtgtgtgtagcaggaggacgtaattccatttataactcctcctaaataaaacgacttgcatgtgaactcttgtctggggcttcccaaagtgagataacccctctctctacccctaaaacaacgagtagcgtctgtcaatgccagggtgcaggggctaaggtgcccatctttgagtttctgctgaggaggacacagctgctacgttggagcactcttgggttctgccttcgtgcccagccatctcccttgggctagccctgccctgggtctatcctagaatgagcctcgatctgtttggccataggcaagcagagtgtctggaaatctttgtcctccatgactggtgctggagccgaagccagtgggtgtggccttgccagccaactccatttacccagctctgaacaagctagtagttgagatcaacggagagtccagacagtcgctccaagcatcttggaatccatggacacaggtgtaccgcagaggcttcccacctgggtaggcagccctttgtaagatcctggcaccacatttattctcttaacatcctttcagttatccagtaatcatttattgagcacctactgtgtgccaggcaatgattaggtgattggagacactgcaacgaagaagacagactaaaatctccaccctggtaggagagacagatgcaaatggtaaacatgataaataatcaatcacccagaaagcaggagacactaagcaaatgtgtatgtactatgggaagcccaataggaacgaaagctacacaagagaacaagtgatgggtggttccttagtctaggtcaggcaatcagggagggcttctcagaggaggtgatgtttgagcagagaaggagggagccaggcagatgttttggaaacagcattctcagcatggagaacagtggcagctcacctacaggatgtgtttgattcccttccagattttgtattcgtttcttgtttttctcccttggcttcctggtttaaatgccttttgaagaaatctaagctcaactaatcagcgatgctgttgaaggtttatatcaggatatgcatcccagagttatttacaaaattagaacaaaactggaagcaattgaaagcctgacaataggagatcagttaaataccgtatggtccttccgtatgatggcatattatgtcatcattaaaaatcgtctgctgggagaatattaaggatacaggggaaaggctcaccatataatgatgagtgggggtgctgggcgcagtggttcatgcctgtaattccagcaatttgggagtctgagatgggtggatcacttgagcccaagagtttgaggccagcctgggcaacacagtgaaacccaatctctacaaaaaaaaaaaaacaaaaatacaaaaatcagccaggcatagtggcgtacatctgtagtcccagctactcaggaggctgagacaggaggataggatcacttgagccctggagtcagaggtggcaataagccgtgatcacgccactgcactccagcctgggcaacagagtgaaaccctgtcaaaaaacaaaacaaaaaaaatgatgagtgggagaaacaagtttttaaacagggatcaaggaggccaggcatggtggctcacacctataatcccagcactttgggaggccaaggcaggcagatcacctgaggtcaggagtttgagaccagcctggccaacatggcgaaacctcatctctactaaaaatacaaaaattagccaggcatggtggcgggcgcctgtaatcccagctacttgggaggctgaggcaggaaaatcgattgagcccaggaggtggaggttgcagtgagctgtgatcatgccactgcactccagcctgggcaacagagcgaaagctgcacgagagaagaagtgatgcatggttccctagtctaggtcagccaatcagggagggttcctaagaggaggtgatgtttgagcagagaaggaggaagccaggcagatgttttggaaacagcattcccagcatggagaacagtggcagctcaccctgtctagaaaagaagaaatgataagaggggaaaatgagtttttaaaaaggaatcaaggggaggtaaaccttatgatctcaaaggtacaaatatgaaaatataagtaaagaaaaactggaggacactgtaccaagctgaccttcgggtggtgggatttgggaatcttgatattctcaatacttctttgtatcttcaaatttctctatgatgatcacagtttactttttttttttttttttgagatggagtctcactctgttgcccaggctggagtgcagtggtgcgatcttggctcacttggctcacctctggggttcaagcaattctcctacctcttcctcccaagtagctgggactataggcatgcaccagcatggtcagctaattttttgtatttttagtaaaaatggggtttcatcatgttggccaggctggtctcgaactcgtaagttcaagtgatccaccaacctcagcctcccaaattggcttgagccaattaaacttgtcttgctaaatggttagcggggagaaagaagaaggtctcgggtcattcctagaccaggaggcagggagaaagggaggagaatgaacctttcttaggcaaacagtgtcctaggtgtccttatcttacataatctgtcgagagagtcacactaaaataaatcattgattgattgattgatacatcaataataaatggccagccttggtggctcacatctgtaatcccagctacttaggaagctgaggtgggaggattgtttgagacaaggagttcaagaccagcctgggaaacacagcaagactcatcttaaaaaaatttttttttttaattagccagatgcggtggctcacgcctgtaatcccagcactttgggaggccgaggcgggtggatcacgaggtcaggaattcgagaccagcctggccaacagggtgaaaccccgtctctactaaaaatacaaaaattagccaggcgtggtggcacacgcctgtagtcccagctacgcaggaggctgaggcagaagaatcatatgaacctgggaaacagaggttgcagtgagctgagatcacgccattacactccagcctgggcaacaagagcaaaactacatctcaaaaaaaatgttttttaattagccgggtgtggtggtccatgtctgtagttccagctacttgggaggctgaggcaggaggattgcttgagcccagcagttcaaggctgcagtgagctatgatcccgccactgcactccagcctgggcaacagcaagaccccatctcttaaataaacacataagtaaataaatgatcatttttattttattattaaatacacaagataaatgaaaaacaggcaaatctttcttacaaaagaattccatttaaagtatgtaaacttcactccccactgccccaggaggtggagactaatctcccctactttgagagtgggctggatttagtgactcatttccgaagaatagagtaggtaaaggggaaaatagaagttttatagcggaggaacagatagataccactttaaccaaatgatgaagattagtatcccccagggatgtggatattatgtaacccttgattttatgcctatatagcgttcttcccaaaaactcctaatcccagttttttggggttttgctctgtcttctaagctggagtgcgatgatgcaatcatagctcactgcagctcaaactcctggtctcaagcgatcctcccacctcaacctcctgaatagctagggctgtaagcacataccatcatgcccagctaattgtatttttttggtagagacatgttctcacacattgcccacgctgtcctcgagctactggcctctagtgatcctcccaccccagcctccagagtcactgggattataggcatgagccactgtgaccagcccagaatttttttttaaggagttgtgatgtcgtttaagagatgtgattcttcataacacatcaacaacaagtcccagcgatgggttggataagtcttgggatttcatgggagtattaagcttaaaagactttgcatgatatctgtgaactatatgtgatttctgttggtaatgggggtcactgattctgcggtttgccacctccaatcatcatggaagaaaatgttccacttccagtgaaagtaagaggaagtaaaggggtaattattttctatctaaattcacgaactccttgaattctgtccacagacccctaagtgtttcctccccaaggtgaaactgagagaatcttgccagtgccttccgcagtcactgtggctagaaaacccctcagaagaggtgatagtttagcaggtaactggagttctcaccatccgtgtctggctcagcccccatcacaaccagttacccagcccaaaatgtcagtagtactgaggttgagaggctctgctctaggaggccaggcctctcagaggaaggaggattggggtactggctgggcctcaagatgaacctaccccctaagagctttgggatggcgtgagtttctgtccatacccaaggactacaaatgcaggtttactggaaattctgtgccaaaagtgaggtccaactcacttctaactgctacaaaacaaacctccatcaacatagcccatctctgttcttgacctggaagctccaaggtatccacatggctcccatgcccactagacgggcctcttccctggaccttcctgggccagagaaggctctgggtagccttgtggaatcaagatgggtgatcagccacttcctctgtgccaccctgttttggctacttccctaggcatcagcctgggattccttgatggtaaaaatataaaactctctgagctagggcctttaatatccccattttacagatgaagaaactgagtcccagagctgtgcacagcgattgagagtcagaattcagctctgtctcactcagtgtcaacatcctcagattctgccatttatagcctcccacagcaaataggattgagggctgcttctctgagctcaaggggatagaatggggaaccccatgagtactgcaacaaaactgtttgctggagacaagagctggtggctctgtgttgttctagtgacaggtggcctcatttcacagggaccccctcaccctatgtgccccatgtggctcagaaaagccagaaattgtctccactctcacaggggaaggtccctgaccccctctttgccagctgggccaaggcaaattggggtcacttcatggggtacaggacctaccctctcttggttgcccccaaggaggggatgtggaggggctggggacctggcaggaccagggtgtcttgagttaatttggggctgcctttagccgagggcttctgtgtgcctggcatcagctttacattgtgtcttgatccgtaaaacagccctgtgaggaaagatatttttaaccccatcttccagatgaggaaacggaggcccacagggtgacgtgacctgccaaggtcccctagccaagagtgacaaagccagggttcacacacagctctggacacaattcatcacccttcatccgtctctctctgactctttctttttccctctctctctttgtctctctttttttttttttttttttttgagacagcgtctcactctgtcacccaggctagagtgcagtggcgcaatctcggctcactacaacctccatctcctgggttcaagcgattcttgtgcctcaacctcccaagtagctgggattacaggtgcgtgccaccacacccagctaattttggggggttttgttttgttttgagatggagtcttgctctgtcgccaggctggagtacagtggcgtgatctcggctcactgcagcctctgactcccaggttcaagtgattcccctgcctcagcctcctgagtagctgggactacaggcatgcaccaacacgcccagctaattttttgtattttagtaaagacggggtttcaccatgttggccaggatggtctcgatctcctgagctcatgattcgcccgccttggcctcccaaagtgccgggattacaggcgtgagccactgtgcctgccaattttttgtatttttaacagagactgggtttcaacatgttggccgggctggtctcgagctcctgacctcaagtgatctgcctgccttggcctcccaaagtgctggtattacaggcatgagccaccatgcccagcctttgtctcttttattcttgtgttctctctctctcttccttctctttctccacctccttctccttctctcccttctcctcacccttctttgtgcttttctctgtgagtttctcttcttctctatttctctcctttggtgaatgtcaattagaaaagcagaaaaactgcgtttaatttgtgatcataaatgcatgtccctggccaggcgtggtggctcacgcctggaatcccagccctttgagaagctgaggcaggaagattgcttgagaccgggagttcaaaaccagcctggtcaaaaagcaagaccccatctttaaaaaagaaaaataattaattagctgggcatggtggtgtgtacctgtagtcccagctactcgggaggctgaggaaggaggattgcctgagcccaagggtttgaagctgcaccgagctgtgattacacccctgcactccagcctgggtgacagaaccagaccctgtctcaaaaaaaacctaataattaaaaataaataaataaataaatgcgtgtcccctggccagtggttgctaatgtttggaatcacctttgacccatgccctttttcattcatagatgtttgtcttgaccaaaatcaaagcattagactttggactataaatcactggttcattcaacaaccatcattgaatgcctactgtatgcagacactcttctggacacagaggagttgacgtgttggtggggaaagccagtgatcagttgggataaaaagggcagacagcagacattaaatagtttaggctttgtgggccagatggtctccatcgcaacgactcaatctgctcctgtagcgtgaaagtaacgacagataaagcgcgtaagtgaatgagcatggctgtgggccaattaaacgttaacctataaaaacaggtggctggcccgcgggctgtagtttgtggatcactgccttagagatagtgttagagggtggtgagaggtccgggatagaataaaacagtagagagtttgtgcattgtcaagatgagaggttgcagttcttcttatacaccccgaatggccgggcaccgtggccattatgatctataattctaacactttgggaggctgaggcaggaggatcccttgagccctagagtttaagaccagcctaggcacatagtgagaccccatctctacaaaaaaaaaaatttaaaaattagctggacatggtggagcatgcctgtaggcccagctacttgagaggctgagatgggaggactgcttgagcctgggaggttggggctgcagtgagccgatcatgccactgcactccagcccggatgacagagcaagaactgtctcaaaaaaaaaaaacaaaaaaacaaaaaaaacagacctgaaggaacaaatcatatgaatgcattaaagtatcacatgtatccaaaaaatatatacatctatcagcctggcacggtggctcatgcctgtaatcctagcacattgggaggccaaggcaggcagattgcctgagctcaggagtgcaagaccaccctaggctacatggtgaaaccccgtctctactaaaatacaaaaaattagctgggcatggtggcaggcgcctgtagtcccagctacttgggaggctgaggcacaagaattgcttgaacccaggagacagaggttacagttagccgagatcgtgccactgcactccagcctggacaacagagcaagactctgtctcaaaaaaaaaaaaaaaaaaaaaaaaaaaaaaatatatatatatatatatatatatatatatatatatatatatatatatataatcaattaaaaattttccttaataaataaacatttctctccttctctcccttggtgaatgtcaattaataaagcaacaaaactatgtttagttagtgatcattaatgtatgtccctggctgggtgtgatggctcacacttgtaatcccagcactttgggaggctgaggcaggagaggatagtttgaggccagcaattgcttgaggctttttgaaagacatgaaggagatgaagggagccatggagatatctcagggaacagcagccgaggtagatggaacagccagtgcaaaggtcctgaggcaggatgttcctggcatttgtgaggacatgtagctgcccagatgtccagtggggagtgagtgaggatgaaggaaggagctgatgaaggaagatgataaaatacttcatggatcagccaggcatggtggctcccgcctgtaatcccagcactttgggaggccaaggcgggtggatcacaaggtcaagagttccagaccagcctggccaacatggcgaaaccccgtctctactaaaaaatacaaaaaagttagccaggcgtggtcatgcacgcgtgtactctcagctacttgggagactgagactcgagaatcgcttgaacccaggagatggaggttgcagtgagttgagatcaccccactgcactccagcctaggtgacagagcgagactctgtctcaaaaaaaaaaaaaaaaaaaaaaagacttcgtgaacagacagcctatataatttatgatccaaaccaggacagttttgagagtgaaaggggaaaaagagcactgaaaaaataattagcaggcctggcatgatctataacgggtataaagtgggacacacagcctctctcacggtcactgtcagacttcagctttttcacactcaaatccacccccatgtttatcccatatactggagaaacgggtgttctcctgagctgagttttggggttttttccttttgttttgttttgtttttgtttttttaacatcctgtatactttttctcaatgaaccatgctcaaaaaaattagaggaaaataaaccataaaacagaaggcactgaaggattttgctgggactcagccattagtttgtttgatgagtatttatggagcgctttctaagcaccaggcaccaccagcgatactgggatgaatcagtaacatccctcacccttgaagctctcttgggcccattgttatttacttaaaatactatgcaagtacggagaaggggtgaagtgggaaaaaatcagttggttgtaaaggccagaatgacgggtctagtcccacccatgccatctgcaccctgtgtgatccaggcacatcatgttgcctctctcagcttcagtttctccatccaccaggcacagagatggcgggaatcgaggaagatgtggggagtatttcatcagcccaaaaagacttggctaatgcgaccataattctgccttctgcctctcctttcccagaaaaatagcttaatcatttggatttgggataaacacatttcctgtgtttattatttaaatgatccaccaagctgggcatggtggctcacccctgtaatcccaactctttgggaggctgaggagggcggattgcttgagcccaggagttcaagaccagcctggccaacatggcgaaaccccatctttactaaaaaaatacaaaaaaattagctgagcgtggtggtgcgtgcctgtaatcccagctacttgggaggccgaggcacaagaatcacttgaacctgggaggcagaggttgcagtgagcctagatcgtgccatcacactccagtctgggcgacagagtgagattctgtccctaaataaataaataaataaataaataaataaataaaataaatgatccaccaacaggaaccccaggaacatttgtattgactatgcaactaatgcttagtgagcacctactatgtccctggtgctgatctggacactgggatttagacaggaaaaatctctaccctggaggagctgatgatcaagatgacaatcttgaaatgcataagttgacaagatgattcagacagtggaacgtgctgggaagagaatgagatgtctggctgagctgcaggaaggggcaagtccttttgattgagaggtccaagaaggcttctctgatgggggcacaatggatctaaggttgagtgataagaagaaattggccaagccaagacctaaaggcagagttgctccaggcataggttcagagaatggaaataattggctgattgtgatcttgaacttgacctttcttttcttctgctaactttgggtttggtttgttcttgcttttctggctccttgaggtacgtgttgggttcttaatttgtaattttttttttttttttttgcttttttgagacagagtctcactgtggtgcccaggctggagtacagcagcatgatcttgactcactgcaacctctgcctcctaggctcaagtgaacctcccacttcagcatccccagtagctgggactactggtgcacagcaccacacccagctaatttttttatttttattttttagagatggggtctcactgtgttgcccaggctggtctcaaacccctagctcaagcgatcctcctgccttagccccccaaagtgctgggatgagaggcgtgagccaccacatctggcctctgttttttgtgatgtaggtatttgatgctataaacttccctcttagttgcttcttggccctttagctaaggtcaagtgtaaacttccctcagcactgcttctgctgcatctcacaggtgttggtgtgttgtgtctctattttcattcatttccaaaattttttaagtctccatcttaatttctgcattgacccaatggttgttcaggagcatgttgcgtaatatccatatatttgcatcatttctgaaattcttcttggtattgatttctagttttatcccacggtagtctgagaagatgcttgacagaattccagtattttaaaatttgttgagagttgttttgtggcctaacatgtggtctgtcttggagaatgtccatgtgctgatgagaagaatgtatgttctccatcagacatgcaagagacagacactttctcacctgcctcatgggatccataaaagagtcaatcagaagttggcatttaagaaagaccagaaggaggctgggtgcagtggctcatgcctgtaatcccagcactttgggaggctgaagtgggtggatcacctgaggtcaggagttcaagaccagcctgaccaacaaggtgaaatcttgtctctattttaaaaaatacaaaaattagctaggtgtggtggcgggcacctgtaatcccagctactctggaggctgaggcagagaatcacttggacccaggaggtggaggttgcagtgagctgagatcacaccattgcactccagcctgggcaacagagcaagaccccatctcaaaaaaaaaaagaaagaaaaaaaagaaagaaagaccagaaagaggtgaaggagcaagctacagagatatcaaactgtatcaatctggctgggcgtggtggctcatgcctgaaatcccagcactttgggaggctgaagcaggaggatcacttgagcccaggagttcgagaccagcctgggcaacagagaccccctctctacaaaatataaaaatttaattaaaaagatgtattggtcagggcagccaagttatgctgcagtaacaaacatccccaaagcctccatgacttttgacaacagatgtatttcctgctcatgctacatgtccagtgcaggttggcagtggggaagaagggggctctgttcagtgcagtcacttgagacctagctaatcacctagaacattgccacttgctattccagaaggaaaaaaggaatgctagaaggtcccacactgaaagttcaatgctctggctccaaaatgacagctatttccactcactcctcattggccagcacttagcatgtggtcctcagccaaccccaaagggactcaggaaggaccatcccaccatattgctggaaatatttgatggcagcattaatggggaacagtgttccaggcagtggaagtctttgagcccttggaagaaagacaaggcgatctctagagcacatccttcccaatattaatgaatttaacaaatgagcaagccatcctcccccactctccttcccgaattcagacttgtgcatatccctcccttaacttgaactgccaaagaagagatgagaaccaggagaagagatctgtgaccccatctttgctgatgaactaccacagaacagccatggcatctccagtccttgtgcttgtaaaatgtacttttcattttgctcctgaacgaaatccacccacccccacccccaaaccagggaaagctcatctcctaatccaaaactgcacccagccttccaccaccttcttccctgggaattgttgattccagagtatggaattgaataattggatgagtttggaagagaaaaagtgtctctaaaatcaggcagcagaagcccactccccagagaggatggtgcagatgagagttcaggagggagcttggcttggggttgacgatctgagctatgcagggaacttggacacacctctcaatcagtcattcaacagacaccacttattgagcaccgactgtgtgccagatgttgtcctagggggctgggaatacaggaatacagcagggaacaaaaaggacaaagcccctccctcttgtcgaatggacattccagccaggaagacgagagaacaagagaaataagtaaagtatataggcggtgaaatgcaaatgggaaaaaagaaacaatggggaccagaaatgaggggtgcaattgtaaagggccatcaggggaggcctccctcagaaggtggcatttgagtaaaaaacctgaaggaggtgaggggaaaccatgtagcaatctcaggaaagagcattccaggcagggagggacagcctgtgcaagggccgaggtaggactgtgcttggcgtggttgagaaactgcaaggaagccaggtggctggaaccgaatgagcgagggaaaaggggaggagataaaagcaaggagatgggagggttggaggccccctctgccattcagtaactgagtaacttcatttatttcctgtagcttgaaccacaaagaaccacaaatagagtagctgaaaacaacagaaatttatttattctctcgcagttcaggaggccaggagtccacagaccatcaaggtcagctgggccacagaccatcaagatgtcagctgggccatggtgcctcctgagacttggtctgaaatcccttcttgcctccctcctagcttctggtggtttgccaacagtgcttggtggtccttgtcttgtagacgtatcaccctgatcccgccttcatctccatttcacatggccttctccctctgtgcaaggttgtctctgtgcccaggtttctccttttcttattatttacttatttgtttgtttgtttctttattttagacacagggtcttgctctgtctcccaggctggagtgcagtggtgcgatcatagctcactacagcctcaaactcctggcctcaagcaatcctcctacctcagcctcctgagtagctgggactgcagatgtgagccactgtgctctgcccagatgtcctctttttataaggaaacccgtcatttaggatgaggttccaccctaatgacctgatcttaacttgattccatctgcaaagaccctatttccaattcataggtaccagggattaggacttcttcaatgcatctttttggagagacccactgcaacccacaacagaactgtgggcatgtaacttgacctctcggccaggcgtgatggctcacacctgtaatcccagcactttgggaggccgaggtgagtggatcgcctgaggtcgggagttcgagaccagcctggccaacatggtcaaaccccgcctctactaaaaatagaaaaattagctgggcatggtagcaagcacctgtaatcccaactacttgggagggtgaggcaggagaattgcttgaacccaggatgtagaggttgcagtgagccaagatagtgccattgcactccagcctgggtgacagagtgagactccatctcaaaaaaaaaaaaaaaaaaaatagacctctctgtgcctcagctttctcacccgggaggatggggataattatatacccactcctggggttcatgagaggattaaatgagctcaaacagtccaagcctccacgtgtgtctgttgtggtgctgggtagcatgtcctgtggccagaggttcccaagcttgtcgaggacccaggcaagggcagattcgggtcttgttggcagcacctgagatggacgggctgccttggtatggaagggcctcggctgtttttccctttcagtcctgtccctctcccccatcctccaccctgtccctgtcatctgagcctgctcctcgtgatggctcagagtctccctactggcggccggtgcagagtttcgttccctgggctatatttagccctgagaaatgggaacgagaaccctcagccgccaaagtgatggagagaggagcacaaagccagtgctgccttctgtccagcaatgttccgctgactcggttctttcttccagaaccttccagaagcaaagcattggcatttctgagctcgttaaaacaaggatgtgggctggtggctggcacattcattgtccccagaacctgtctgtgtccatgattaaagctgactttgttagttttattttcagtgcttttttttttttttaatccatggcaaaacacacatgacataaaatttaccatcctaatattttttttaactttgtaacattttttaattgacaagtaattgtacttattcatggggtacatagtgacgtttcaatgcatataatgcgtagtgctcagatcagggtaattagcatatccatcttctcagacctttattgtttctttctgttaggaacattcaagctcctccttctagctatttgaaaccattaatatattgttgtcatcctaaccatttttaaggatacagtttcgtgaaattaagtataatacattcacattgttgtgcaactgtcaccaccatccatctcccaaacttttccatcttccaaatgtaactctgtccccactaaacgcgaactccctgttccccctcccccagcccttggcacccaccatgctactttctgtttttataaatctgacgactctagggacctcctataaatggaatcatacaggattttcccttttatgactggtttatttcacatagcataatgccctcaaggttcacccatgttgcagcacgtatcagcattttctttctttttaaggtaaagttgactattaaaaaaaaacttctgccgggctcagtggctcacgcctgtaattacagcactttgggaggccaaggcaggcagatcaggaggtgaggagttcaagaccagcctgaccaacatggtgaaaccccatctctactaaaaatacaaaaattagccaggcatggtggcgggcgcctgtaatcccaactactcaggaggctgaggcaagagaattgcttgaacccgggaggcagaggttgcagtgagctgagatcatgccactgcactccagcctcggcaacagagtaagactccgtctcaaaaaaaaacaactttttaagaattgaagtagaataaacatacagaaaaatccgcggattataagtgaagagcttgattaattgtcacaaactaaacacatccatgtaaccagcacacaaatgaggaaacagaaacttctcagccccagaagcccccctcatatcctgttcctagtcactacctccccgcaagggtacccctaccaggactttgagcatcattcaccagtttagcctgttttgtattttgcataaatgaagtctggcttcttttgcttgacgttaactttttaagatctcatgtgacctgtggcattgttcattgcatgtatcctctctctcctattgataacagtgtggattgtttgcaatttggagctatgatgaataccattgctatgaatgttcttgtgtgtgctttctgttgtgtaattattcagaattactatttcggaattactatctaattgtagtgatcttggatcagtaactatccaagaattactgggtgttggcaaaggtacatacagttatacactgcacaatggcattttggtcaacaacagatcaaatatgtaacagtggtcccataatggaccgaatacataacagtgattatcatacagtatttttactatagcttttctgtttttagattcttttttttttgagacgaagtctcgctctgttgcccaggctggagtgcagtggtgtgatctccgctcactgcaagctccgccttctgggttcacgccattctcctgcctcagcctcccaggtagctacaggcgcccgtcaccaggcccggctaattttttttgtatttttagtagagacggggtttcaccatgttagccaggatggcctcgatctcctgacctcatgatctgcccgcctcggcctcccaaagtgctgggattgcaggcgtgagccaccgcacccggcctgtttttagatatttttagatacactatagagttacaattgcctacagtattccatagaataacatgctgtatgggtttgtagcctaggagcaataggcgagaccatgcagcctaggtgtgtagtaggctataccatctaggtttgtgtaagtacactccatgatgtttgcacaacaaaatgacctagtgacacatttttcagaatgtatgcccattgttaagcatgacttaattttagcatagaaactctcaaccaatttttcaagtagttgtaccatgtgttatgggttttattgtctcaccccaaaattcatatgttgaagtcctaacccccagtacctcagaatgtgaccttatttggaaatagattcattgcacatgtaaaggttttgccattggcaaaactgccgttatttttgcaccaaccatagcagttaagatgagatcattagggtgggtcctaatctaatacgatggtgtccatataaaaaggggagattttggcacagagacaggcacactcacaggaagaatgccatgtttaaacaaaggcagagctcaggatgatgcctctacaagccaagaatcagcaaagattgccagcaaaccgccagaagctaggagagaggcataaaacagattctgtctcacagctctcagaaggaaccagcccttctgacaccttgagcttggatttttggcctctataactgtaagacaataaatctttgttgtttaagccacctaggttgtggttccttgttacagcagccacaggagatgaatacagcatggtgccctcccattggcagattatgagggttccagttgctccacagcttcacagacacctggtagtaatgacctcatcttaacttctttctcattttagcctttcttccaggcagcagcagtgtcatacatgcttttaaaggtgggcttttaaagccacacttgagagccctgcattctgcaggtgtcacagggtgatcaactattcaaaggctacccctgccctgacagctggaggcaaggcttcccagcacagaggttaagcccatggactctggggccaggtggttagtgcaaatcccatgtccactagtgaataactctgtgatcttgggctgatgattttgtctttctaagcctcagtttcctcaatagtaacatgggcattataacatagaggcatcatgaggattaaatgactaagtgagctaacatacataatgtgcttaggaaggtgccagcacaccataaatactctgtaagtgctggcttttatcattcttttctctctctctctctctctctctctctctctctctctctctctctccctctctctctctgtctctctttctctctccaccccccaacctcctctccttgattttcttcccctcatcttacttccttcttgctatagtgttctattttctgtttcagagagtattctatttgtggacttttttcctcttgaaaattgagctgaaacttctgagaattttttgtgattggcattaaggctgcagggaatggagcagggagacacttgaggaaagggctcatggaccatctgtctggcttggtgatttcaccaggccatcagactctgtggtcatgcatctcctctaaggggagtctatgactgtgttgggagaagagaaggaaccagggattaattaatccatttcaataggttttgtgttttgtttggtttactttttccttctccttctggactgtggtctgggaagtcctcttgtgtttcttactccattcccaggtcaattatgttatgtgaggagaacataattaagagagagctttaccctttggatgttttcttcagaaaacgttcctccatttccccctctgggatgccagagccccagaactccacaagccaagaacatttaagacagagccacaagagaaccgagcttccccttccctcacctgtcaggttctatctgagtcccagtcaactctcacctgctttccctcctcacaccctacagagcaacgatgcctcagggaacacttggaactggttgtacttcatccccctcatcatcatcggctccttttttatgctgaaccttgtgctgggtgtgctgtcagggtaagtttctgctactccccaccccatcccactcactcctctttgctaacttctttccaagtagaggccattgaagctttgttttcattcactagacagagaaaaggcttcttcccttgtttgggttaccagactgttattagcaagccatgcacaggtgcagaggttgtgtactgctaggggtacccagtgagagggttcatatgggctttactttctttacattttttttaaaaaccaatagtttgggtttacttctcccccattttccaaatataaaatcatagcatatgctctaacggtgtattttcctgacccatattgtcctctatccccaagatttttttggcttaatcataaatgggcttcatttttcttaccataagaagtctgggcacttgtatggtggctctatggcaccatcagcaaccccagattcttccagctttccattctgacatctttaccagaggcttccaatctcgtggatacctcatggtcttaagatggctgcctcacgccctccggatggccacttcatgttccaaacaggaaaaggaagaagggaaacaggaagaggtgggacctatggcagagaagccaacctgctgcagaaatctttcattcatggcttattggtctaacttaaaagagggctgaaataattattagccaaaagtatgaagagaatgagaatgaggtatgcagccagtggtggttggcatggcatggttttatcctttcggtttttttcttttttattgtttttttttgagacggtgtctagctttattacccagactggagtgtagggggcgatcatagctcactgtaacctagaactcctaggcacaagcgatcctcctgcctcagcctcctgagtagctaaggcaacaagtgtatgccaccatgcccagctacattttttatttttcatagagatggggcccactgtgttgtccaggctggtctcaaattcctggccttaaatgatactcccatctcagcctcacaaagtgctgggattacagacatgagccactgtgcctggcctttttctttacctaggcacagttgtcgggaaatgtgtgaagctggcagaagcacccatcactataatatcccagtcttttcccagaagtcctgactcctcctgttgaaaactcctgacctccagggacttctgaatccccaaacacacacacacacacaaacacacacacacacacacacacacacacacaaacacacacacaaacgtttcctaacattttcaaaacagccatactctggcttttctatgcttctccagggagtttgccaaagaaagggaacgggtggagaaccggcgggcttttctgaagctgaggcggcaacaacagattgaacgtgagctcaatgggtacatggagtggatctcaaaagcaggtgaggccctttcatcctggggcccagggatggagatcccaggccacggagtacaaagagagtcatgcagtttggagaaggctaagctgggagggttatgatgggaggagaaagagaacctgaattggtagtcccaaattttatcaacaagaatccagagtctgatatgaagaagtctaagatgaagccaggatctgacatcacgtaacttgaattctgaaatcagacgctggtttacatcccggccctgccactttttacccatgcaccacacatccctgtacctccgtttcctcagctgttacatggaggcgatggtagtgcctaagtcatagtactattggagtatttagtaaaataatctcagctgagtcacttggggagagaagtgcctgatacacggtaggcacatatttatttgttcagccatttaacaaacatttagggagcacctgctgtgtgccaggcactgatctaagcactgaggatatgggagtaaacaatacacaccaaatccctgccctcagagctctgatattctaatgagagagataaagcaaacaaatacatgtcatgttgggaactcccaaattcagagaaggaagataaaacagactaggaagataaaacagagtaggaagttggccgggcgcggtggctcacgcctgtaatcccagcactttgggaggctaaggcgggcagatttcctgaggtcaggcattcgagaccagcctggccaacatggtgaaaccctgtctctactaaaaatacaaaaattagccaggcatggtggcgcacgcctgtaatcccagctactcgggaggctgaggcaggagaattgcttgaacccaggaggcagaggttacagtgagctgaggtcgcaccactgcactccagcctgggcaacagagtgagactctgtgtcagagaaaaaaaaaagagtaggaagttagaggcagggtggtcagggaaggcttctctaaggaagtaccctctgagcagagagacctgaaggacgtgaagaaggaagctgtggggatgtcaagggaaggggcattccaggcagagacagcaagtgcaaaggccctgagctaggaacgtatttgagacacagcaaggaagccagtgcagctgaaacagagtgagaggtggggacagctggaggagaggaagacaggaaggtgatggagatcagatcaagcaggggcttataggctgtggtgtggacattggtttttattttgcgcgaggtggggagaatgttggctattgctactgttgcggaggtggggcttgaagtcacaaaccacccagcagcatgttttttggtcggttgagctgtcaccatcagtcagcagagaatgggggtggccgggcagacccttcttcctggtccaagggagaactcatcctccaaatgcaggagcttaactctgtgctcttcctcttcagaagaggtgatcctcgccgaggatgaaactgacggggagcagaggcatccctttgatggtaactgctctaaacccacctcaggggtgggtcccaggggagaagggagaagctgtggtggggagtcgggggagagcaggtgactggttctaaggatcttgcagagggtagacgttcctcttggaggaattttaggacttccatgcagagtttccctattctggcctccacttttttgttttaaccatggacctggttttttctgctttgtgccttggtttttctcatctgcaaaatgggtatgatataaacaataccctagctcacgagattgtttctcagaatgatattcgttatggcaaatagaacacctgggatagtgcctggcatggggtcagcacgtttctgtttgctaaataagtaataattccaccaataatccagtttactgtgaacggctgctgtctcccatgttagaaacttaacgagacagaaccatgactttctttcttttcttttttttttaattgagacagagtctcgctctgtcacccaggctggagtgcagtcacacgatctcacctcactgcaacctctggctcccaggttcaagcaattctctgcctcagcctcatgagaagctgagattacaagcatgagccaccatgcctggctaatttttatattgttgatagagatggggtttcgccatgttggccgggctggtcttgaactccttgcctcaaatgatctgcacaccttggcctcccaaaatgctgggagtgtagatgtcaattcatggtcccctggaaacctgaatatgaaaggagggaccattaaaaaggtgtccaaaagcccaacctccccagcatagctgggagtcaggggacagactgtaagagtcactgtgtatccaacctgaggcttcatgaaagtaaagtttcctagaatttagagatagggttggatgcggtctgtctgtggctcacatctgtaatcccaacactttgggaggccaagacaggaggaacacttgagcctgggagttcaagaccagcctgggcaacataatgaggttccgtctctacaaaaaataaacttagccagatgtgggggcacacgcacctatggtcccagctactcaggaggctgaggtgggaggatcacttgagcccaagaggtcgaggttgcagtgggcaccactccactccagcctgggtgacagagtgagaccctgtttcaaaagaaaaaaaaagaatttagagataggccagaataatatgtctgcaatataataataacagcaataagaaaaataatagtactccctgaaaaatgcaacttcttgcttgagatttatcttctcatactttagaaaactggttagacaggggctgggcgtggtggctcatgcctgtaatcccagcactttgggaggccaaggcgggtggatcacttgaggccaggagttcaagaccggcctggccatcatggcgaaaccccatctctactaaaaatacaaaaattagctaggtgtcatggcacacgcctgtaatcccagctactcaggaggctaaactacgagaattgcttgaacctgggagacggaagttgcggtgagccgagatcacaccactgcactccagcctaggcgacagagcaagactctgtctcaaaaaaaagaaagaaagctggttagacagggtgatgacttttgattaaaaatctgagagatttgagggaaataaaagaactggcactgcgtcccagaaggttataaaatgaattttattatcttagttggggaggggagattacctaactcccctaaatgagttaggtaatctaactcatttagggtacctaaatctttttattggaagtctacacctgaacttgtctgctgtggagcccctggggtgtatagcttgaatatgggggcagaatcccaaaattgcagcctgcctagcgagtatgctacaggtcaaggggtggactgttttcataagaaagtgaggtttcttagaatttaaaaatagaggctgagtggggcggctcacgcctgtaatcctagcacttttggaggccaaggcaggcaaatcacttgaggtcaagagtttgaccagcctggccaacatggcaaaaccccatctctactaataatacaaaaattagccaggcgtggtggtgcatgcctgtagtctcagctactcaggaggctgagggaggagaatcgcttgaactcaggaggcagaggttgcagtaagccaagatcacaccactctctgggtgacagagcaagattctgtctcaaaataaataaacaaataaataaataaaccagaaggaaaatagtggctgagggcccagacctggagtcggactgaacccgacttgattcttgtctttacccctttaagcaaagtgatagtgccaccttgaacctcagtttacacatctgaaaaatgggtatactattagttcccgtgagaacagttgccgtgagagttaaatccaaggacacactgtgtccatatggtctgtgttgcaaaaagggtaacgtctttttctcttgccatgtttccattgttggagctctgcggagaaccaccataaagaaaagcaagacagatttgctcaaccccgaagaggctgaggatcagctggctgatatagcctctgtgggtgagtcccttcctctgccacctatcagttgttcatcacctatcgcccaagagacatggtggggtgggggcagagggcttgcaaaccgtgctgcctggatttgggtctcagctccaccctttcccacctgtgcgtgtgtcctgggcagattacatcattatgggaataacatccgtgcctagcttctcattattttgtgggaattcaactaaatgatccccatgaagcatggcaaaccagcacctggcagggacgaagctcccagtcaagttggtgaatgtttgtgactcattcgggaagtattcatgggggacctgcttatattaggtgcttggttgcaaacaagacaaggcagtcacgaggctgagctgggaggatcacttgagcctgggaagtggaggctgcaataagccattattgtgttactgcactccagcctgggcacagaaaaaaaaaaaaagacacaaactgagccaggcacagtggctcacgcctgtaatcccaacactttgggaagctgagatgagcggatcacctgatgtcgggagttcgagaccagcctggccaacatggtgaaaccctggctctactaaaaatacgaaaaaaattagcctgtagttccagctactctggaggctgaggcgggagcatcacttgaacctgggaagcagaggttgcagtgagctgagatctcatcactgccctccagcctgggcaacagagcaagatcctgtctcaaaaaaaaaaaaaaaaaaaagacacaaaccaaatccctacctacatggagctcacagtccagtgcaggaaatagaaattaaacagagaattacacaaataaacctgtaatggtaatggcacttcagggagaggctctgggcttagcttgctctagaaggatggggagcagtcagggaaggctacctggaggaagtgacggttaagctgggaactgaaggatgggtaggagatcactgtggtggtgatagcagaaggaacagtgtgagaggcagggctcagacctttgccaccacaagggccagagttcgagggaggagggaacatttattctttcccttctcactcctctgtcctattgattcattggctgtgatgatgttgattttgaccttctaaagtgagaatgtattgttattgttgttgttgttctttaatgggtttttgtttttaatggaaggaagagcatccaggcagaggaaataagactggaataagattgaggggagaaggaatttaggctgcttgggaaactgtgtggccgcagtttagaggaagaaaggatggcaagagaaagaggaagggaggaagagaaggagggagagaagtgaaggaaggagggaagttagtacatccatgtgtttctgatccatagtttctgatccactatttcgtattccccttttatcgctcgcccctagtttataaccttattgctgagtttaggcataatttccattgcgatcacatatctcgtagggtggatacactatggtttgtttagccatagctctattatagggtgtttgagttgtttccaataatttctcttacgaagaacactgctgtgcacatttacgtacaatgactccccccaccctttgggcgtatttccttggggataattataggatcaaagatattaacagcttttcaactcattattcaaagagccattctgagtttcaaaaacatggaacccatttataaacctgccaagtatgcatatgttcatggattccccacccaggccatcgaatattaccaatttaatttcctttcccagttaagtgggtttgtaatgaaaccttaaagcttgttttcatttgcatttttaatttccagccaaaacacgcttttctttgtaatggagaactcattctgcttccactcgtgtgtgcatctgtttaatttcctgtaagcaaatgtcaagaattggagcgctcagtaggtgtcttgagtatttgatcaattatgtctgtctcacgtgttacgttacctccattgtttaaaatctgttttatgacgaggtacagtggttcacgcctgtaatcccactgctttgggaggccagtgcaggaggatctcctaagatcagccgttcaagaccagcctgggcaacataacaaggctccatctctgaaaaacaaaatgttgaaaaacttagccaggcattatggcacacacctatagtcccatctatttaggaagctaaggcaggaggatttcttgaacccaggaattcaaggttgcagtgagctatgattgtgccactgcactgcaacgtgggcaacagagtgagaacctgtctcttaaaaaaataaaataacatacattcttaaaaatctactttgctggccgggcgcggtggctcacgcctgtaatcccagcactttgggaggctgaggcgggtagatcgcttaaggtcaggagtaggagaccagcctggccaacatggtgaaaccgtgtctgtactaaaaattcaacaattagctgggtgtggtggcgtgagcctgtaatcccagctactcaggaggctgaggcacaaaatcacttgaacccgggaggcggaggctgcagtgagctgagatggcgccattgccctccagcctgggcatcaagagtgaaactccatcaaaaaaataaaaaatctgcatatacatatatatgtatatatatttttaatttttttaatttttttttttttttctgagatggagtcttgctctagcacccaggctggagagcaatggtgccatctcggctcactgcagcctccgcctctgttaacaaggcaggtgacattgcagctttctaaacagacccaaaacccaggccagtggcttgttctttcatagccacgtttgctacaggcaaatccaccaaaacccacctcatcagcctgattactcaaaaagacaaagaaaggagcccccaatctagccagtggttttctagaccaccccaaaagagatctctggaattccaggattctggcaaggaatcacatttagctttatttatttatgtaaagaatgcaacaatacaggctgggtgtggtggctcacgcctgtaatcccaacattttgggaagctgaggtgggaggatcgtttgaggtcaggagtttcagaccagcctaggcaacatagtgagaccctgtctctatcaaatattagctgggcattgtggcacacgccagtagtcccagctactcgtgaggctgaggtggatcacctgagcccaggaggtcaaggctgcggtgagccacagcatgcccctgcactccagcctgcgtgacagagacttcatctcaaaaaaaaaaacaaaaaaaagtaataatacagtaatgcatatttcaaagtaaggtgggagctatgtggtatttgcgttcacgttcacattataccacagtatgcacagtccttttttttttttttttgagacagtgtcttgctctgatgttcaggctggagtgcagtggtgcaggcatagctcactgcagcctcaaacccctggactcaagtgatcctcccacctcagcctcccaagtagctgggactataggtgtacactgctacactcagctaagttttttatattttttactagagatgggatctcaatatgttgcctaggctggtctcaaactcctggcctcaaacaatcctcctacctccacctcccaaagcagtgggattacaggcgtgagccaccacacctggcccacatgcagtcttatataattggtgattctactgcgctgttgaatcagttgataaacgcactataaagcaggttcattcctaattgatgaacttactgctgaaataaggaacttgaatcatttacatgaaaagttgagccatgttgctgaaaggatatcaatttttttttcttttttttctttttttttgagatggagtcttactctgtcgcccaggtgggagtgcagtggtgcgatctcggctcactgcaacctccaccttccaggttcaagcgattctcccacctcagcctccaagtagctgggactacaggtgcacaccaccacgccctgccaatttttgtactgttagtagagatggggtttcaccatgttggccaggctggtctcaaactcctgacctcaagtgatctgcccacctcagcctccgaaagtgctgggattacaggtgttagccaccgcgcctgacaggatatcaaatttcatttagactgcaggaatacgttcaagagatctattttgtacagcctggcgactgtattaataacaatgtattatatacttgaaaattgctcagagagtaggttttaagcattctcaccgtgagaaaagtgataagcatatgtaataatgcatatgttaactagctcaactgagccactccatagtgtatacatatggtcaaaatatcatgttatgcactataaatagatacagcctgtatctgtcaatttaaaataaatgaataataactttaaaaagaaaaataacagtatggctgggcacggtggctcacacctgtaatcccagcactttgggatgccaagacaggcttgaggccaggagtttgagaccagcctggccaacatggcgaaactttgtctctaataaatatacaaaaatcggctgggcatggaggcgggcgcctgtaatcccaactacttgggaggcagaggcatcacttaacctgggagatggaggttgcagtgagccaagatctgcactccagcctgggtgatagagtgagcctttatttatttctgtaaagaatgcaataatacaggcctggtgcggtggctcatgcctataatcccaatgttttggaaggccaaggtgagaggatcatttgaggctacaggcgcatgccacagtgcccagctaatacttgatagagacacggtctcgctatgttgcccaggctggtctcaaaaccctggcttcaaatgagcctcccaccttggcctcccagagtgttgtgattacaggtgtgagacactgtacctggcctgtattaaaaaaaaaaaaaagaagaagaagaagaagaggaggaaagaagaagaaggaagaaggaagaagaagaagaggaggaggaggaggaatgggaaggggaaggggaagaagaagaggaggaaggggaaggggaagaagaagaggaggaggaaggggaaggggaagaggaagaagaagaggaagaagaagacgaagaagaagcacaatgataaataagtaaaatgtggagcatatgaaaacaaaacaaaaaaaagttgatccattatgaatggaagctgccattgtaactctgcttttttaggaaaaccagaccccatttagatgattttatttgtttttaaaggcaggttcttgctctgtcactcaggctggagtgcagtgatatgatcatagctctctgcagcctggagctcctgggctcaggcgatcctcccagcttagcctcccaagtagctgggactacaggcaccaccacacccagctaatttgttgttgttgttgatgttgttgttgagatggggtctggctatgttgcccaggctggtctcaaactcctggcctcaagtgatcctcctgccctggcttcccaaagttctgggattacaggcatgattttttattaatttatttgcagctgacaaatggtaattgtgtatgtttatggagtgcagtgtgatgttttaatctatgtatacatcatagaatgattcagtcatgctaattaacacatccatcgcctcaccacctcaccgttttttgtgtgtggggaaggcattaaaaatctcttagcaattttgaaatatgcaacacattactatttattaataatgcaatataaatacacaataatgtattaatgcatcactaaatgcgatgcaatgcaatgcaatgcaatagatcactaaaacttactcctccagtctaactgcaacttataccctttgatcaacatcttctccttctcaatccctcctcctcccctgcagcctccaggaaccaccttcctgctctttctatgagatcaattttttttagttttaagctcccacatgtgagatcatactgtaattgtctttctgtgccagcttattttactcagtataatgtcctccagttctgtccctgttgtcacacattacagaatttctttcttttagggctgtatagtattctatttgtatacataccacattttctttatccattcatccattgtgggacacttagtttgcttccatattttggctattgtgaataatgctgaagtgaacgtgggagtgcagatgttctgaaaagacttaaatgtcagacctgaaatggtaaagatgctccaagaaaacataaggagaaagctccatggcattggtctcgggaatgattttttggacaggacctcaaaagcacaggcaacagaagccaaaatggacaaatgggatcgtatcaaactaaaaaatttgtgcacagcaaaggaagcgttcagcagaggaaagagacaacctaaggaatgtgagaaaacgtttgcaaacaatacatctgataaggagctaatatccaaaatatataaggaactcaaacaactcaacagcaagaaaacaacccaattaaaaatgggcaaagacagctactcgggaggctaagatgtgacgatcccttgagcccgggaggaggaggttgcagtgagctgacattgcatcactgcactccaccctgggcgacagaaggagaccgagaccctgtctcaaaataaaaaataaaaatgtgcaaaggatctgaacatacatatcccaaaagaaaagacatacaagtggccaacaggtatatgaataaaatgctgaacatcactcatcatcagggaaatgcaaatcaaaaccaccattagctatcacctcacacctgttagagtagctattatctttttgtttgtttgtttgttttttgttttttgttttgtttttgagagggagtctcactctgtcacccaagctggagcgcagtgttgtgatctcagctcactgcaacctctgcctcctgggttcaagggattctcctgcctcagcctcccgagtaactgaaattacaggcacacgccaccatgcccagctaacttttgtatttagtttcactatgttggtcaggctggtcttgaattcctgacctcaaatgatctgccctccttggcctcccaaagtgctgggattacaggtgtgagacactgtgcccagcctagagtagctattatcaaaaagacaaatgaggtttgttgaagttctaacccctggtacctgcaaatgtggccttacatgaaaatagggtctttgcaggtggtaatcaagttaagatgagatcaaacttaattagggtgggtcctaaatccaatgactgctgtctttataagaggagaagcaggctgaccaacatggtgaaaccccatctctactaaaaatacaaaaattagctgggtgcagtagtgcacacctgtagtcccagctactcaggaggctgaggcaggagaattgcttaaacccaggaggtggaggttgcagtgagcagacgtcatgccactgcactccagcctgggtgacagagtgagactccatcttacaagaaaaaaaaaaaagacaaatcataacaagtgctggcaaggatgtggggaaacggggatccatttacatcattttaataacacaggctctatatgggtggtattgagttcccagagttgccattacaaaatgtcacaaacccagtggcttaaaacaacagaaatttcttctctcacagttctagaggccagaagtccaaactgaaatcaaggtgtcagcagagccaccacgttccctcagaaggttttaggggagaatctgttccatggtattttcttagtttctggtgctgccagcgatacttggtgttcctcagttcatagatgcataattccagtctctgcctctgttgtcatatggtcttctttctgtgtttctgtatgcgatttcttttttttttttttttttctgagacaagtctcactccatcacccaggctggagtgcaatggcacgatcacagctcactacaaccccaacctcacaggctcatgccgtcctcccacctcagcctcccgagtagctgggattacaggcgtgtgccaccatgcccggctaatttttgtatttttagtagatacggggtttcaccatgttggccaggctggtctcgaactcctgaccttacgatctgcccatctcggcctcccaaagtgttgggattacgggcacgagcccaccgcacctggccctaattactttatttttttgtaaatttttttttgtaaatttcatgtagcctgagcatacagtgtttataatatatacaggagtgtacaataatatcctaggccttcacattcactcaccactcaactcactccctcaccaagagcaacttccagtcctgcaagctccattcatgccaagtaccctatgcagctgaaccaccttttctcttttatactgtgtttttactgtaccttttctatgtttagatatgttcagacacacaaatactatgatgttacagttgcctacagtattaagtacagtaacatgctgggcaggtttgtagccgaggagctacaaaccacgtagcctgggtgtggagtaggctacaacatctaggtttatgtaagttcactttaagatgctcacacaaggacaaaattgcctaacaatgcatttctcagaacacgtctccctcattaagccacacatggctgtattacaatttacatataattttaagcgtatataaattgccagaaatcaccagatgaatccttggcggtgacataccccttcccccaccatagaacattgcagactggcccggacgcccagtatctcatgcctgtaatgccagcactttgggaggctgcagcgggcagatcacttgaggttaggagttcgagaccagcctgaccaacatggcaaaacaccatctttactaaaaatacaaaaattattcggacgtggtagtgggcacctgtagttccagctacttgggaggctgaggcaggagagtcacttgaacttgggaggcagaggttgcaatgagccaagatcgtgccactgcactccagcccgggtgacagaatgagactctatctcaaaaaaaaaagaaaaaaaaaaaaaaaggaaaagaacatttcagactggtaccagttacaccggctcttgatcccttgaatgtggctgaccctgaactaggatgtacttcataataacacgtccggctgggaatacttagtacaaaagaaagagtataaaatatcttttgaatccaccttgatattgattccatgttgaaatggtaatattttggatgtattgggttgaataaaacatctcatgaaagtgatttttaaaaatctagaaattgtctgcaattataattccagaccacagagaaaaacgagagacaggaatgtatagaaaaagggaacgtgggacaaagtgagtatgaaattcaactaacagaagtgacagtgcctagcatggggtccagcacttagtaggtgttcaattaatattcatttccctctcccttaccagtgaagggtatgcctgtcgtggggaatgtgtcttcaggctgagtgatcaggaaggactttctcaatggctggcacgtgaacctagtcatgatttcagctcttgaggttgtactagaagatttatatccaataatcgtaaggtaccacttagcatcacgctaagatgtattaattcatttatgcctttggatggccctttgaggtaggaagtgtggttgtctccagtttaccaaggtggcttgcccaaggtcatctgctggttggtgattaagccaggttttcagtgtggctccagcaggagtgggggctggggaccttctacctgctgtggtttctctctctctctctctctctctctctctctctctctcgatctgtggaacatcccccctgtcccccaaggtcccaagggtcttatttcttttggccaagccctttggagacctgcagatctggacacatctttgagagtttcaggaactagggccagaaatgctgggcagggtcatgaggagctgccactggggttgagaaggtgatggacatgaggggaagggtctttgcagaaaggagaggcgtccctgtaagcaggtcacagccactgggcctggccaactgcagccgagtggaatgtgcccctgccccatgaccatatgccccaggtgtgcaatgtggcggcccagagcacacactctgaaccatcttgacacatcttcactggttactagacccccctcagcctgtttccttggctgtaaaatggggatgacgctggtccctacttcctagggctctgagcaggagtaagtagcttgtcgtataaaacatgttccctgcagtgcctggtgcctgctaaatgttccataaacgtcagctgttattttcattcaggggaagctgaaatccatattttcatggaaaatctcccagtttttaaatgtggaccaataatttcagctttcacaaacccagtatgagtcggtatggcccctagggtgccaactcaaaatctctgttgagaattttgctgataggaagtggcctccttggaggtgtttgctgtgtcctgtgtctggcaagtggggtggttttgataaacgtgctggatggatgtatgggtgaatggataaatggaggaatgaatggagaaacaaatgagcaaatgaataatgaatggatggatgaatggatgagcgaatggatggatgaatggatgagcaaatgaatgatgtacacacaaaggaatggataaatgatgaatgtgctaatgaatttaagaatgatgaaagaatgaatgaataaatgaacaaatggatggatgaaagaatgaatgaatgtactaatgaatgaatcaatcaatgaagaaccatttaaaaatgaatgcaactgagggtttataagaaaaggtatcttaagcctgggcatggtaattcatgctggaatcccaatgcttagggacgctgaggcgggaggatcgcttgaacccaggagttcaagaccagcctgggcaacacagggagacctcattgctaccaaaaacaaaattgttttaattaagcgggcatggtggtacgtgcctgtagtcatagctacttgggaggctgaggtgggaggatcgcttgaacccaggagttcaaggctgcagtgagctaggatcaagccactgcattccagcctgggcaacaaagcaagatcctgtctcaaaaaaaaaaaaaaaagatgtattttagaaggtaaattcaatctgtccaaaactgagctctgaccttcccctaaacctgtgcccattcagtggatgagagctccatcccttaaggggttcaccaattcatccattcctttgtatgtacatcattcattcaccttggctcatccctctctcttacatccacaccgttccatcagcaaatgttgaatctgtcttaaatgattcatcccaaatcctccccgcttaactaccacccaactccagcccccatccatcatcatcatcacttgcctggatgggttcagtcacctccagcctggtctcccagctcccgtcctcacctctcactgtctactctcccactcggcagccagagggtgcctgtgaacacccaaatcaggttccatccctcctctactcagaaccctccacggctcccccctcactcagggtaaaagccaaagtcctccttgtggtccaccaggccatgcatgatctgcctgtcacctccctgccttcaccaccttcctcttttcccctcaaccactccactccagccacactgacttccttgtgctcttccccaaaaatgtcgggcagacacattcatgcttcaggaccttaaatttgctgtttcctctacctaagatactaaagtgacaagtcaacacactcaccttgaccatgcaatttaatgttgcagcctaccctgtggactctccaagggctcccagtccctctgtgatgctttactttttctcttaaaaaaaaaattgttatttaaaagaacttgtctcgctgtgttgcccaggctggtgtcaaactcctggcctcatacagtcctcccattccagcttcccaaagtactgggattagaggcatgtgccactgcacccatcccaactttttttttcccatagcacttttcattttccatcccactgttaatttacttattacgtccactgtctgtctcctccccttagagggtcagaccccggaagtccaggctctgttgcctaatgtatcctgagcccctggaacagagcctggcacaaaataggtactcaataaatgcataagagcaaaactatatgtaggcagaggacacacccagcttattcctcagtgatcacttctaaagttaaatgtccatggaaaacagtctcatccacatctctttctggaggccttccaagcgtgctccatgcagctctgttgcctgcccctgcatcagggaatggaggctctgctttatcctgccctgtggtgtgactcccagaggcatcagatgtggctgggagtgggagacatggaaaattggctcctgcaacagagaactatcagccttcccatcaattggttacttctaattctgttatttttcaggggcactgtcttctcataagctccatctatgcaaaactaagcccatgggtcatgatggttccctcaggccagaggcttgctggagagactaatggatcccctggctaaaatctgtgcttgggctgcacattggttaatttcttctgaaggaacagcctgagcctgacattctccatcttttccctggcaggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttgtgagtatcacccagccccacccctgccaactccctgatccctccctcacaccctttttccacttctctttctctggtagtatgtgtatcttctttggtcctcattgaatctgccctttcctttagccatttctataactgtcactggggccaatgttactgttgctatgacaatggaacccatctcccttagacctgagagctggaagctggaattcagaccaacaaatgctcctgtgattcctttctaagagagagggacagaggggtgctggtgaaggggatgttggaagagagacagagaaagacggagctcataagatagacagatagaaacagaaacatacatgtattaataatttttatgtacatctctggaaatgttcataacttatggttaagagaggatgccttagaaataaggagtggcttatatgttgccctcattttctctacttatttctgactctacttctctcttctttcaaaccttctgcttctttcctgttaggttggtgcaaaattaattgcgttttttgccttttttttttttttttttaaccacagttacttttgcaccaacctaatacttcctcccctgccctttttggcttccttattcattcatagaacatcccctccagtatctgcgagagcgttttgctccctcaaggtacaaggcccactaaggctttgccctctgggcctattcccagattctatgtgagttagcatgagatagtatcaaaattgagggccaagtgagggtgaggaaaagcagcaaaagatggggagatgtctgagcaggatttaaaaagtaaagagctcgaggaatcaacaagagcagcgactggggccaggcatggtggctcacacctgtaatcccagcattttgggaggctgaggtgggtggatcacttgaggccaggagttcaagaccagcctggccaatatggtgaaaccctgtctttacaaaaaatacaaaaattagccagatgtgatggtgcacacctgtaatcccagctactcaggaggctgaggcactagaactgcttgaatccaggaggcagaggttgcagtgagccaagatcatgccactgcactccagcctgagcaacagagagagtgtctgtctcaaaaaataaagtaaaataaaataaaataaaataaagagtagtgattgggcagtgaggggggcaggtggatgccctggctttggctcacaggccccaagtaaggacttctcaaaacgtcttttgcctactggctgtctaatttattcactgaccttctgacctggttcagaattgacttaggacagcaagaagagacagtctagtctttgacctagaaaggcccgtgagcctagtccaggccattgtcttcttataaccctccttgttcccagtcacgttggctgaccccccaggacacccctcaggaaccagttctccttcccagggccctgacctagtttcaaacttagtaattgtttttagtccctctggagtctcttataaatgaggactctacttcgtgttttaacttcctctaatactctatttttaatctcctatattctctctactaatcatcttgtacagtctgtcctggttcaggaacaagggactgagacttcctgcctgggtcctcagtgtctataaaggtcctttactcattcccactttccctttgagaaaactgagacacagagaggttaagtagattgcccaggatcacacattagcttggcatgatggcgggcgcctgtaatcccagctacttgggaggctgaggcaggagaatcgcttgaacctgggaggcagaggttgcagtgagcccagatcatgccactgcactctagcctgggcaacagagctagacgccatctcaaaaaaaaaaaaaaaaaaaaaaagatacacattaatttcagagatgtcaaaatataaacaaaaatgtatatcttggcatcagtgaagtgtagttgtttctctggatctcagactccacatctatgtggtagaaaccggatttgatggtcctgaaagttcttccagatgcaacaatgctaaggataagtaattctttcaagtcttgtgcatcacctgctatcatgtttccatggtaactgaggaacaagatctcagaaactcttcagtcctcccagagttacttctggtgggtctaggaatgtgtcagatgttacaaacagacttcctctgctgatattttggtcctaggaaccctagagttcccctcagacactaagatctccttagcgtcctataaataaggagaaattttggtgataaatactgtgaaggactttgacggtcagttcaaaacacctcttaaaagcatgacatagcaaacacccttggcaaatatcttagttcatttgtactgctataacaaattacccgagactgggtaatttgataagaacagaaatttattttctcacagttctggaggctgggaagcccaagatcaaggcattggcaggtttccctgtctggcgaaagctactctctgcttccaagattgcaccttgaacactgtatcctctggaagggaggaacactgggtccttacatggcagaaggtggaggagcaagagggacaaacttcctctgtcaacctcttttataagggcacctaatcccattcatgagagctctaccgtaatgacttaatcacctcctgaaggccccacctcttaatactgttacattggcaattaagtttcaacgtgaattttggaggggacacaaacatttaaaccatcacaaccaccaaacacaattagctttgtggccttaattagctatatgaaattcatggaagttagtttcagtcctctgtctctttcctttctgtatgctttctgctcctcagaaaccctcctcatctctcctttctatccattaagtacccacgcccttcctaactcctcatcttcctaccctaccaagaaagccctctcagaaaaggatctgatgtcagccatttatttgctggagcaaatgcatatccatgttttacccctccctgaggcatttgcaattttatgcttgctcatcaaagaacaaaaggctttgtcttactcaagactttttaggtcactcacaacacaggatttctaggggacataagacaagttttctgagttaggagaaaagccataccttaggtgggttgcctgtgtcgctccaactaagtacttaacttcaggattacaaataggatatcattatgatttctatttccttttatcctttggagctcagtcacgtagaagtagattaaatataattgttagatcacagcaccctggcattatggggccgttatggtccattgttattatgtgaattattcagttaattagtttattttttaaatgtgataaacacccaggaacccaccagtcaacacaaaagtccttggcaataatctatatccgatccttctcatcgaaccagggcaaaaactacaagatggagacccactgatatttttctcattccttttaaaatcggcctaaggttggttagcttgttggttggagggtagggcataattgttgctttttttttttttttttttttttagacaaggtcttgctctgtcacccaggctacagtagggtggcccaatcttggctcactgcaacctccacctcccaggtttaagtgattctcatgcctcagcctcccaagtagctgggtttacaggcatgtgtcaccacactggctaatttttgtatttttagtagaggcggggtttgccatgttagccaggctggtctcaaactcctgacctcagttgatctgaccgcctaggcctcccaaagtgctgggattacagacgtgagccaccatgcccagccagctcttcctttttaacagaggggaaactgaggcccatgggaaggacaccttggacagggcgtggccacagtgggtcatgtatataatcccagcactttgggaggctgtgctgggaggatcacttgaggccaggagttcaagaccagccagggcaacatagtgagacccccatctccacataaaaattttaaaaagaaaaaagataagtcagaagttgggtgtggtgacacatgcctgtagttctagcatgttggaggccaaatcagggaaactgtttgaggccaggagtttgaaaccagcctaacagcatagcaagacctcatctctacaaaaaataaaaagtttaaaaatgataataaaaggaaagtcagagccacctggaacccctaccctcagcaagcctaacctcctctctgtttcctccttctcccttctagactatgcagaattcattttcttaggactctttatgtccgaaatgtttataaaaatgtacgggcttgggacgcggccttacttccactcttccttcaactgctttgactgtggggtaagtgctcttgtttctaagagttcatttctccagctcttgcctggaatgacagatacctggacacattaaagggagaaaggtaaagtcacccctgaatatgagagactcagatggatgcagaaggaatgagaaaacaatcccaaacactggcaaggatacagtgtacccagaaccctcaaccaccgccagtgggaggaaaacgtatagaccccctttggaaagctaagtgggggacataagacaagttttccaagttgggagaaaagccatgccttaggtgggttgcctgtgtcgctccaactaagtacccaacttcaggattacaaacaggacatcaatatgatttctatttcttcttttcctttgtagctcagtcatgtggaggtagatgaagtataattgttagattacaacaccctggcattatggagccattatggtcctttgttattttgtgaattactcagttaattaatttattttttaaatgtgattaacacccagtaacccactagtccacacaaaacctaagtcctggagaataatctacgtccaatccttctcatcgaaccagggcaaaaactacaagatggagatatgacccagcattccattgctaggaattcatcctagaaaatctcacccagatacctaggagacacaggccagaatgtccctgcagctggaagtgaaattaaggttgttcgcaaataagtggagaatgcctggcccagggcagccctaatcatttaccatagtcctgttggtctcagaaaggcttaataatttatttatttttttttattttttgtttttattttttgtttttgagatggagtctcgttctgtcacccaggctggagtgcggtggcgccatctcggctcactgcaagctccgcctcccaggttcactccattctcctgcctcagcctcccgagtagctgggactacaggtgcccgccatcatacctggctaattttttgtatttttagtagagatggggtttcaccgtgttagccaggatggtcttgatctcctgacctcgtgatccacccgccttggcctcccaaagtgctgggattacaggcgtgagccaccacacccagccagcttaataatttataataactgaatgttgtactgttttctgccattatagaaaattatgttgttggagaaaacaaaatacatacaaacaagcaaaccttccctacataaatgacccaagtagttaaagaataaaaccaatttctttccattaaaaagaaaagaaagccgggtgtgatgcctcatgcctatagcctcagctattcaggaggctgaggcagcagaattgcttgagcccaggagttgaaaaccagcccaggcaacatagcaagaccctgtctctacaaaaattaataataattagccaggtgtggtggtgcacacctgtagccccagctactcagaaggctaaggtgggaggattgcttgagcccagcagtttgaggctgcagtgagctatgatcacaccactgccctccagcctggacaagagagtgagaccccatctctaagaaataaaagtaggccaggcacagtggctcacacctataatcccagcactttgagaggcggaggcaggtggatcacctgaagtcaggagttcaagaccagcctggccaacatggcgaaaccccgtctatactaaaaaaatacaaaaattagccaggcgtcgtggcacatgcctgtaatcccagctacttgggaggctgaggaaggagaatcacttgaactggggaggcagaggttgcagtaagctgagattgcaccactgcactccagcctgggtgacagaatgagactccgtctcaaaaaaaaaaaaagaaaaattttaaaatgtcctgagcaaccttgtttgtaatagttccaagtctcaatatccgtgtatccctttgctgtagaacagataaatattttgtggcatatctatataatgaaatactctgtgacaatcaaagtccaccaacagcagccacatgcccaacaacaggaatgaatctcacccatgtaacatggcacagaaggaggcaggagctagcaacgtaagtccatacagttcatgcaaagttcaagtggacaaaattaaactctctctctctctctacatatatatatatatatatatatattttttttttttttttttttttttttttttttttttgagacagagtctcactctattgcccaggctggagtgcagtggcgcaatcttggctcactacaacctccacctcccgggttcaagccattctcccgcctcagcctcccaagtagctgggattagaggcatgcaccaccacccccggctaattttgtattttttgtagagaccgggattcagcaatttgcccaggctggtctcgaaatcctgatctcaggtgatccacctgccctggcctcccaaagtgctgggattacaagcgtgagccaccacgccccgccttaaactgtattttttaaggatgatacttgaatacgttaaaaaggcgaggaccttgaaaacacaacgctcggtaaaagaaaccaaacacaaaaggtcaagtattgcataattccatttgtatgaaatgtccagagcaggcaaatccatagagacagaaagtagattagtggttgctagggtctgggtgagggagagtggggagtaactgctcatggggacagggcctcctttgggggtgatgaaaatgttttggaacttgatagaggtgatagttgcagaatattgtgcatgtacctaaaggcactgaattgtgtaattcaaagtgtgaattttatgttatgtgaatttcacctcagttttttttaaggtaagaaaatggttattacaaaattcaggatggtagttatatcacagtgtctctggaaacttccagggtatccacatgtccctttttattttattttattttttattttatttgagatagggtcttgctctgttgcccaggctagagtgcagtggcaggatcatgaccctctcctgtctcaaattcctaggctcaagctatcctccctcctcagcctcctaagtagctgggactataggcacatgccaccatgcttgactaattttttttttttttgtaaagtcagggtttccctgtgttacccaggctggtcttgaactcctgggctcaagtgatctgcccacctcggcctcccaaagttccagaattacaggcatgagccactgccctagccttctcctaattgttgacataggtagtagttgcatgacattcactttgtaattatgtgtttcaggaattctcaggcctgtgggagctcttaataaataaaaaagaggccaggtgtggtggctcacgcctgtaatcccagcactttgggaggccgaggcaggcggatcacgaggtcaggagttcgagactagcctggccaacacagtgaaaccccgtctctactaaaaatacaaaaaattagccgggcgtggtggcgggtgcctgtaatcccagttacttgggaggctgaggcaggagaatcgcttgaacctgggaggcggaggttgcagtaagctgagatcgcgccactgcacaccagcctgggtgataagagcaagactccatctcaaaataaatgaataaataaaaataaataaataaataagaggccgggtgcagtggctcaatgctttggaaagtggaggccaacagttggagagaccaaagcaggaggatggcttcagcccagaagtttgaggccagcctgggcaatactagcgagacactatctctataaaaatgttttaaaattagccagatgtggtggggcacacctgtaatcccagctactcaagaggctgaggtgggaggatcacttaagcccaggaggacagtgctgcagtgagctatgattgcgccactgcactccagcctgggtgacacagtgagacccggtctctatagataaatgaatggatgaatgagggggtcaaggatcctcacccggcttccatttggagggaggagtttggttgagttcttgcaaggttggtacctaggaaatgcttgccagttctggagcccagacactgtccctggacatgagaccaggttctctgccctaggttatcattgggagcatcttcgaggtcatctgggctgtcataaaacctggcacatcctttggaatcagcgtgttacgagccctcaggttattgcgtattttcaaagtcacaaagtaagtctttggggttcctggacatttgtacagggggtggggatgggggacatggtggggccgcctccagaaagttgggaaagtgagcctcgtgtttcgagggctgactccggggccctgcctcccccgcctggcctgagtcctcgcctggcctctgtcggcaggtactgggcatctctcagaaacctggtcgtctctctcctcaactccatgaagtccatcatcagcctgttgtttctccttttcctgttcattgtcgtcttcgcccttttgggaatgcaactcttcggcggccagtaagtccttcacaggaattccaactcctggttccctggggtcaggctcagggaacacacagtcccctccaccgtgcaggctgccttcctcgtagcccagacacccattgcggtcacccaaatgggcagggccctgggtaccactcagggtttcctggggacagagatgatggagacgttcgtttccttggagatgagatactgagccacaccctcagagcaccccgggtggggccaacgtgaaatgtctgtgtcctccctgcaggtttaatttcgatgaagggactcctcccaccaacttcgatacttttccagcagcaataatgacggtgtttcaggtacagcctccacctggccccacgggccaacacctctcagtgtcacagatgaaagtgcctgctccacatccaaggggcttccctgaactcctccttctctacctggccttttcacaccactttgaaacacagattttatggttatcattattcaattatggtgaggccaacagatcaggagatgaatgtcattggaaagatagtttgtggctgggcacggtggctcacacccataatcccagcactttggccaggtacggtggctcacacctgtaatcccaacgctttgggaagcccaggtgggcggatcacttgagatcaggaattcgagaccagcctggccaacatggtgaaaccccatctctactaaaaatacaaaaattagccgggcgtggtagcacatgcctgtaatcccagctactcgggagatgaggcacaagaattgcttgaacctgggaggcagaggttgcagtgagccaagatcgcgccactgcactccagcctgggcaacagagtgagactccatctcaaaaaagaaaaagaaaaaaaaaaccactttgggaggtcaagatgggaggactacttgaggccaggagtttgagacaagtctgggcaacatagtgagactccgtctctgcaaaaaaataataataataattagctgggcatggtgatacatacctcctagctactagggcagctgaagtggaaggattgcttgagcccaggaggttgaggctgcagtaagctacaatcacaccactatactccagcctgggcgagagagcaaagccctgtctcaaaaacgaaaagaaagtttgttatactcacagatcctcagagaaggagcacaccatgcaggaccaagcagagaagcaacagggtcaagcaggaagagaaggaaaatgtgggcaagaggcttgattgtggtttccatgggacggaatgggtgaggcagagtaaacagctcgagactggctagtttggatcatttcagtgggctctggggcagaggagctgttcctacttgtctaggacctggccttggggtgattagggcaggtggatagtgctgggaagataaaggaggtggttgggatatgggctggttgggatattgtttggtttgcttttaaaaagcctgctcagggctaaattgtttactacctctagggactggctagtgctggaccgggcagtccctccagagtcagcaagaccccagatgcatcagaataaagaaaataaaatgcgtggccaggccaatgaggtggttcatgcctgtaatctcagcactttgggagaccaaggcgggaggattgcttgagcccaggagttcaaggctgccgtgagctccagcctgcaccacagagcaaggccctgtctcttaaaaaaaaggcagagaaaaaaaatggctaatacacccatcaaatctgaagataccttggtctcatattccagggtgatcaacccaaagcaacttctgcacccatgtgggcgcattccctgaggcttgggactggcccagccgggaccttcagagcatctttggtggattctttctctttgagggactgagagtgtatagaaaatgtgacttcactctctccttctcctggggaggtagtttctaaatgagaccccaagacagggagttgaagaggaaaccttccatgaagggaagttctgagcccccacataagcgattttttttttttttttgagatggagtctcgctctgttgcccaggctggagtgcgacggcacgttcttggctcactacaacctctgcctcctgggttcaagcgattctcctgcctcagcctcccgagtagctgagactacaggtgcatactaccatgcctggctaatttttgtatttttagtagagacagggtttcactatgttggccaggctggtctcgaactcctggcctcgtgatctgcctgcctcggcctcccaaagtgctgggattacaggcatgagccaccacacctggcccataagcgattattaatagcactgatcgctagtcatgtatctttagctcagaggttctcacccaaggacaagtctgtcctccaaggacatgtagcaatgtctgcaagcattgttggttgtcacagctagggagagggtgctactggcatctggtgggtggagactaggaatgctgctcaatatcctacaatgcacaggacagccccaaatagaataatctggccccaaatatcagcagtgctgaggcttagaaaccctgttttagcagattcatgtttttggagttctttaacatttactttatcctcatggggatatggatagaaggaaggaagttggatcttttttaaaggagcatgtaggtgctgtttgaatatccccttggttctttcagtatgcatcagcacaacttgcgtctgtcaacacctaatcctttgccttggtctttctctggtcccctgctctgcccccaaggaactgcagtccagcagtactgtgaattttttgtgccacaccttaaaaggagcagccgttggtggataaataccccagctccctcaccctcaggtgggatgacccctagagctccccagcaagaccaagccccggttacctacagtggaaactcgcttgatcacatactgtttacgttccaccctcttttcccttttctcacttctcctctcccctactggtgcttcctgagatcacctcccagacaaaccacttgcacccgaacccttgttccagggtctgcctcaggcagggggaccccaaacgtgtccttgtgctacatttgtgctatccacgtagtagcttgtttaatcatcaccatgaccacatgaggaacacaggtaaatattaaaatcctgtcttagtctgctcaggcagccataacaaaataccacacactgggtggcttatacaggaaacatttattctctcatagttctggaggccgggaagtccaagatcaaagtgttagcagggttagttagttcctggtgagggccctcttcctagcttgcagatagccaccttcttgctgtgtcctcatatgtcaaagagagagagagagagttgtgatgtttcttcctgttctttttttttttttttttttgagacaaaaatctcaaaaaaaaatctattttttttttaggcaaatcacatttttttgtcacccagcctggagtgcagtggcacaatcatagctcactgcagcctcaaactcctaggttcaaacgatcctcccacctcagccccttgagtagctgggactacagatgggcaccagctaatttttttaaattttttgtaaagatggggtcttgctatattgcccaggctaatcttgaactcctgggctcaagtgatcctcccaccttggcctcccaaagtgctgggattacaggcatgagccatggcatgcggtctcttcctgttcttataagggcactaataccatcatgaagtcccccatgacctcatctaaccctagttacctcttaaaggccccatctccaaataccatcccatcataggttagggcttcaactcatgaatttggaggcgggcacaatttagtccataacaaatccccttaatcacatcaagtaagacagagttacaggagggtctgtgactcctccagggtcccattttcctagaagccaggctaagagccccacgacgcaggaacggccctttctactcgcaaacaaagagaaaagccaaggagaagccaacacggagtctggctctgcaaaccgggcaggattgttaaagacctcctgggctcggggatggggtgggcggattccggctccacagctgcatctccaaggggcccgtggctgagaggggggttggctgtgtgtttcttcctcccctttcagatcctgacgggcgaagactggaacgaggtcatgtacgacgggatcaagtctcaggggggcgtgcagggcggcatggtgttctccatctatttcattgtactgacgctctttgggaactgtatccttcatggagagagagaaggggacaggcctggacctctggcagaggagaggttgcaggggctcaagggagggtactgagagacccagatacccagggcccaagtggtgtcccaccagtggttgcttttcctgactcagacatttgcagacaccctcctgaatgtgttcttggccatcgctgtggacaatctggccaacgcccaggagctcaccaaggtggaggcggtgggagaatgtttctctggcaaagttaccacctgcccatggcagatcaggacgggggtgggggtgggggtgggggtgggggtgggggcatgggaacagggttagaacttttgccggggatgcaccatgcaaagagaaggcgcctctccccccactcccagaaacagactgtccctcatcaagcaaattctacagccaagagggtgggaagggggaaggcagtgaggtcgctgcaggaaacggatggcaaactcaaccaaaaggccgtttacagggagtaagcagggtttccaaggaatggtgtagcccccaggctagtggatgggagagggagtgctgttatggggacccagtcagagctggggccaaggaaaaagggctgccaccagccctgggaccttagagaacccagaaccatggcaaggcacagatggagtggccaataaatgtccccaccttctctcttcctctggcttcccgctggagcctccccttagccaaacgcagcatgttaagagctagcctccgtccagcctaagcctctccccaaggaccctattaagttaagattacatgtaacaggtacagggtcttcctctcagccctggggtctccctcagcattgcagccccacctccagtgcctcgaggtattcaggacatgtttgtgaaattgaaccaaaccaagcagacgttgccaacgctccatctgccggccctggcaggagggagagagagtttcccggccccagctcccagtggagggaagcggaagtctctgccatcccaagcacacggccacaagcctggccactgtggagctggctggcatggctgagccgagggctgatccagccatgagctcatccaagttccaagagtccatccttaggggctggtgcaggagggtagcagaaggggagggagaaaggccagttcgtttatctcctgggaggtgtggacattcctctccagatccacattctttctttcattgatcctacaagcatttcttggtcatttaatacgtgtttttaatcctattcagtcctcatggaaaccttaggagccaagttctctgagccccattttacagatttcatcattcagtaagcacttaatgagcacctactgtgtgaccaaggccctggtctaggacttagggattaagcagtgaacaaaaaaaggcaaaaatccctgcctccgtggagcagggattcaagaggggagacagacaagaaacaagataaatttgtaaacatacgtagcttgtcagttggtgataaacacaacagagaaaaattcagtagggaaagtcagggagagttggaattttagatgagatgtgtgtcgcacagagaggttgagagacttgcccaaggccacacagcagtaagttgtggagctgggatttgaacccaggccgtctgggtctgcagcttgtgctcttaactgctgtgtaccagttgcttgaatttgggcatgttttatgctcacttgggaacctgtgggaaatgcagattccagggcccagcactggttctatagattatttggggagcctgaggatctgcattttaggtgtttctgaggcagatggtccagagacctagctctgaaaaatgctgggaatggtgccaggaggggtgggggtggccctatgagagcagggtggccagccagatcccatctccatgttgtctctgacagtgtcctgatctgaccatttccaaggtggtaaggttgctccccgttccagtgattcggagcacagcgggagagctgcctgcaatggcatgacttttcttatgggcgggttcatttctggccatttctttctcgttgccttttctttgctttttctttgttggcttttctgttttacgaatgaggccctgcatgaaggctgaagaaggatttaaagtccaaaaacgtctttttctgtatgtatttttaaaacctcttcccccattctcctcctctctgaacctaaccaccagtgagcagcagcaccctgggcagttggctgtagcccaagtgccctgctctcctctccccaccgccttcctgtcatgggggctgggaatataaattcctctcctcattctccttctgggggctgttgacagtgcatggcaggggccatcggatgccaggctcttctgtgtgtgagggtagttggtgttttttgaaagttggttcagagagttcacatggctcagaaagcctagtgagaggaaaatctttgcactgctttccagctcattaagacaggatgcaggggccaggcatggtggcacatgcctggaatcccagcactttgggaggccgaaatgggaggatcatttgaggccagaagttcaagaccagcctgggcaacatagtgagaccctgtctctacaaaaaaaaaaaaaaaattaaatgtatacaggcatagtggcatgcacctgtagtcccagttgcttgggaggctgaggtgggaggattgcttgagcccaggagttcaaggttacagtgagctatgattgtgccactgcactccaggctgggcaaccaagggagactctgtctctgaaaacaaacaaaagaaaaaaaaataggctgcaggaaagtcttcattgtaggaagagaagggacatttttattttttgttatctggctgtgtgttaaaataggcttcataatgagttagatgtcaaacttatacacagaggggatagcaatacacttaaccaatagcaggtacccattccaattggggagccttggttctgattggtcgaaatatttcaaatgttgcccctggtcagcaacagggtcagaagtgagtccccaaggcctagttcatgttttgtgaacaaagattccacgtgccttttaggacgagcaagaggaagaagaagcagcgaaccagaaacttgccctacagaaagccaaggaggtggcagaagtgagtcctctgtccgcggccaacatgtctatagctgtgtaagtgcccctaatccctgggatgctaccctggctcctgaacgtccacactatcccaggcacagatttgggaagcagtgggggtggtccttgacagaactgagctttaggaagagacacttcttgtccttccacccactttcactcaataaatatttggttagcagctgttatgtacccagcactgttctaacttctggggatacagcattaacaaggaggaaaaaaaaaatcccacctgtgtgtagccattctagcaagggaaggagtcaataaattagataaataagtaaattatatattgtgttagaaggcgatggaactacagagaaagtaggggagggaaatagcaaatgctgggagtgaagagagttgtgattttaaacgaagttgtcagggaaggcatcacctagaataggggtccccagtcccggggctgtggactggtaccaggccgaggcctattaggaacggggctgcacagcaggaggtgaacagtgagcaagcaagcattaccgcctgagctccacctgccgtcagatcagcaggcagcattagattctcataggaacacaaacactattgtgaacggtgcatctgagggatctaggttgcgtgctccttttaagaatcgaatgcctgatgatctcaggtgaaacagtttcatcccaaaaccaccccccacacctaggtctgtggaaaaactgtcttccacaaaactggcccctggtgccaaaaaggttggggactgctcacctagaaggttacatggcctgaaggaggtgagggaggagccactggggggcctggggaagggcatcccaggcagagggaacagcataggcaatggccctgaggcaggaacatgcctgatgtgaaggaggcctgtgtgactagaatcgaatagtaagtgtgaggaggtgaaggcaaggaggtgacaagcagattacacagggccttctgggtcaggggggaggacttgggcttttgcccctagccaggtgggagccatggagggttcttgagcagaggaggctgggacctgactcagatgctcacagactcctagcattcagtggggagtagagggtggagagcaggagtgggaggctgagatgtgggttggttcgcctgggtcatccatccaagctacagtgcctagcaatgctctaagtcctgtgaccatgccactgcaggaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaagtaagtggaggtgacctcgaatccgcagaatgacggtaacattaataatgacaacagccaaagtagcacgtgctgtgtatttgtttataaaaatatattataaaatgctgtatttggccaggcgcagtggctcacgcctgtaatcccagcactttgggaggccgaggcggatggatcacgaggtcaggagttcaagaccagcctggccaagatggtgaaaccccacctctaataaaaatacaaaaattagccgggcacggtggcaggcgcctgtagccccagctactcaggaggctgaggcaggagaatcgcctgaaaacagggggcggaggttgcaatgagccgagatcacaccaccgcactccagcctgggcgacagagtgagactctgtctcaaaaaaaaaaaaaaagtgctgtatttggccaggagcagtggctcatgcctgtaatcccagcactttgagaggccgaggcgggcggatcacttgaggtcaggagttggagaacaggctggccaacatagtgaaaccccgtctctactaaaaatacaaaaattagtggtggtgcccacctgtattcccactactcaggaggctgaggcgggagaatcagttgaacctgggaggtggaggtaggttgcagtgagctgagatcgtgccatcacactccagcctgggcaacagagcaagactctgtctcaaaaaaaaaaaaatgctgtatgtttttgtttttttgacacagggtctcgcctgttgcccaggctggagtgcagtggcagtcatagctcagtgcagcctctacctcccgggctcaagccatccgcctcagcctcacaagtagctgggaccacagacatgtgccacatgcctggctaatttttgtagagacagtgttttgtagagacagggtttcactgtgtttcccaggctggtctcaaactcctgaactcaagcattccgcctgccttagcctccctaaagtgctgggactacagggttgagccaccacactcagcctaatttttttacctttagtagaaatgaggcctggctctgttgcccaggctggtccccaactcctggcctcaagcaatcatcccacctcagtctcccaaagtgttcggattagaggcttcacagatggggaaactgagagattgagtgagctcctcaaggtcattcctctaaccagtgtccttgaacccaggctctctggcaccagaggccttgagcatttcagggaaactattaagagaagccccactgtcgtccagaattatatagtcttctgtgttcttgctgtgtgacttttgcaaagtgacttcatatctctgggcctcacacaatggaaatagtgggatctaattgggtcattgccaggattgaatgaggtaatgtatgcaaagggcctggaagagcagctgacacataataagtgctcggtaaatttagagcatttttggccattttcagccaactctatttacctaatgctattctttggaagtttgaaaagccactctgttgggaggccaaggtgggaggatcacttgataccaggagttggagaccagtctgggcaatagaggcagaccccatctctataaaatataaaaaattaaacagatgtggtggcatgcacctgcagtcccaactacttgggaggctgaggcaggagggtcactggagcccaggatgtctaggctatgatgagctatgattgcaccactgcacttcagcctgggcgacagagcaaggctttgtctcaaaaaataaaataaaaaataaagaaaaagaaaaggcactttgggccgttagaattgaagggagagcagagtttcaaagctttggatgcagcgggatgtggtggctcatgcctgtagtcccagcactttgggaggccaaggtgggaggatccacttgagccccggagttcaagaccagcctgcgcaacatagtgagacctcaccttttaaaaataaataaaaatgttagaaagcttttgaggcatcttccaggccagcaacttatccattcagaaccagcatcctctttttcataacgacattttgtaatactttctagcagatgctatagtgattctgcatatagggactcaacaacttacccattaaaatagacatcgtagacattgtcctattacaaattaacctgctcttagtcctcttttatattaccatcagggcataatattgatttttttaatgatgggtttaagtgatcctgttgtatgacatatgaggtaggccagcacttctcaaaatctaatgtgtatgtgaatccccagggatcttgttaaaacacaaattgtaattccgtagggctaaggactcagtggagcctgagattctgcatttgcaacgagctcccagatgaggctgatactactggtccagggaccacattttgagtaatgagactctggaggacatagtgaagtaattctgatatgtacaccatacacaaaatcaccatgaagtgacaggcacaaatgatggctaactctgggttgtgtggacaattcaaaccacatgaggggagttgccagcagtgtcaagatgttccacaatgttgaacacctcttggcaaagttccatatacaaaagagtctagtctttcttccatttatttaatagttgcattgcaggaaaatgcaatgtatattaaaaacatacaaaaaatatgttgtgttcttatgtaaaagagttaggtttaaactaaaagcacaggatcaggtgcagtggctcccacctgtaatcccagtgcattgggaggctgaggaaggagaatcgcttgaggccaggagttcgagaccaacctgggcgacataaggagacctcgatctctacaaaagaagttttttaattagccaggtgtggcggcaggtgcctgtagttctagctacttggaaggctgaagcaggaggattgcttgagcccaggagttcaagattacagtgagctatgattatgccattgcattccaacctgggcaacagaacaagtccttgtctcaaaaaaaaaaaaaagaaagaaagaaagaaaaaacccaaacaaacaagcaaactaaaagcacaggtaattacaagcaagatttttcacctctttgagggacattagaaagtcatgaagaggaaaagataagtctttcccatatgggactgtcatgtacatggtagggtatttagtataactgcctaccattctctaagtgcctgcagtgcccctcaatcattatgttattaggtttccacgtagttctacaacagttttctgaaaaccattgttctaggtcattctttcgcttcaatcttctcctatgggtttatgcattcattcagttagtatttactaagtgcctactatattctaagctcatgctgtgagttcagtcacacaactgcaagtgaagtggtctgagacattctgagaaatacgaccaagaaactgctcccagggtctcagggcaggtttccagaggagcaatctgagaagggagtagagtgtttcagtctaacaacagcatgtgcaaaggccctggggtggaccagaaggaggccagtttgcaggacatgactagtgacgagaaagtgacaaagaaattgaaggtgcattgatgagactctggggctgtcagtcactcaggggaatgagagatcaaaacgggagtttaggtggaataaagtgtttaccacagcactctctgtatagtaaagaccaatgaagagccaggtacaggccagtgtgatggttcacgcctgtaatcccagcactttgggaggcagagacaggtggatcacctgaggtcaggggttcagaaccagcttggccaacatggcaaaaccctgtctctactaaaaatacaaaaaattagccaggcgtggtggtggacgcctataatcccagctactcaggaggctgaggcacaagaattgtcctgcgaggcagaggttacagtgagctgagatcacaccactgcactccagcctgggcaacagaacaagactctgtctcaaaaaaaaaaaaaaaaaaaaaaagccaggtacagtggtatgcacctgtaatcccagctactcaggaggctgaggcaaaggattgcttgagcccaggagttcgagaccagcctgagcatttagagaatgggaggccagtatactaaataccctaccatgtacaagacagtctcatatggaaaagaattatcctttcctcttcatgactttctagtgctcctcacacaggtgaaaaatcttgcttataattatctgtgcctttagtttgttggtttatttagggttttgtttgttttttttttttttttgaggcagggtcttgctctgttgcccaggttggattgcagtagcattgctcattttagagatgagcaagacctcatgtctaaaaaaaaaagaaagaccaatgattattaattactcttgctattattactaatattactgttattatcagccttattaacagatctactgttattgaaggaggcagagtgacagggacaaaatgtctctccctaacaatatgccaggaagagtttttgaaagacaacagtaaacattggaaactacaagagcagcaaagcctggttgtgaaaggcaaggactttggggcaggcagtcacattcctgccctatcacttccaggctgtgtgactttcagaatttcactcctctctgggcctccatttcctcatctataaaatgaagataagaatagtagctacctccttctctgggtataagatttaactgagccgggcgcggtggctcatgcctgtaatcccagcactttgggaggccgaggtgagcggatcacaaggtcatgagttcaagaccatcctggctaatatggtgaaaccccatctctactaaaaataccaaaaaaaaaaaaaattagccgggcgtaggtggtgcacgcctgtagtcccagctactcgggaggctgaggtaggagaatggtgtaaaacccgggaggcggagcttgcagtgagccgagatcgcaccactgcactccagccggggagacagagcgagactccatctcaaaaaaaaaaaaaaaaaaaaaaaagatttaactgagttagtacgtgtaaaatgctttgagtggttcctggcttataccaagagctcaataaatgttagcaattttttgtagcattttggggtctcactatgttgcccaggctggtgtcaaactcctggcctcaagaaattctcccactttggcctcccaaagtgctggatttacagacatgagacaccatgcctggccatgttagctattattaatatgaatattattaagtactcaatgaatgctatttttagcagtaatagtaagcactcaggaagtgtcagctaatactgttagtaatactctcatcaataaacataaaaagcaataaggacccagcttgcccaaatcccacagatggttcctgctccctctcttcttcagaggaagaaactatctccccactttcacccccatagcctcagctggccagacccccattctgaaccaggggagtactgctaattccattattaatagacacatcaaacaatctggccgggagagacattattcatttggctgataaagaggttctaaggctctttggaaataaaagttcatgaagattcatgcactttaagagaaaaaaattcaagatcagtcattcatctgctttaaaaaaagtggcaaagataaaactttatttgagaatataaaataataaaaagacattttcgttctctgttgtgacaaagccagtggccttcggaggtctgccttgtacatttttcctcttcttcagtcattccttgaggctttttgcaaacgtaccctgtgtttttcattctccagcatattgataattttttttttttgagacatggtctcgctttgtcatccaggccccggagtacagtggtacaatcatggctcactgcagccttgacttcctgagctcaggtgattctcccacctcagcctcccgagcagctgggactacaggtgtgcatgaccatgcctagctaatcttttgtattttttgtagacacagggttttgccacattgccaaggctggtctccaactcctgggttcaagcgatcctcccacctcagcctcccaaagtgctgggattacaggagcgagctaccttgccaggccgatcatatttttttcctttttattcactttgtcttctcctcattcctaccttcatctgtctttcagtggctcactccagtgaaaagtggactgacgcacattctatttcatataattcaatggctgctggccccagatcccccataccaggtggccgagcccagtggccctgcagggtggacaaaatgagggtggaactttcccagactgtcagtaaaaatctatggaggacagagcttctgcctctcccttgcaaccaggcagtgccttctcccaggcctatctgcttgcaaagggaacttttgccaagacctgctccactctagaattcttatctctgctgttcgcatcctaattccacctgcatctgtcaccatgacaacctgctccccaaaaggaacaggaagagagatgctggacttttgagctccacagtttatcctgcatgggggtagggagtggttaattacttagcactctaattcttacggtacccccaatgggcccaagttggtttttttaaaaaaaaacagtcttgctctgttacccaggctggagtgcagtggcacaatcatagctcactgtagcctcaaactcctggactcaaatgatcttcccacctcagcctcccaagtaactggaacaacagtctcgtgcaactacgcccagctaattttttttttttttttttttttttagagatggggtctcactatgttccccagactgatctcaaactcctgggctcaagcgatcttccttcctcagcctcccaaagtgctaggattacaggcgtaagccactgtaccaagctgccccattaaagctttgaacaccagagagcccagctcagctgttttccagctgggtaactctgggtaactttgcctctctgaacctcagtctcctcctgtgtgaaatggggctgatcactatacccatctcggatggtggtagttgcagggattaaatgagttaatacgtgaggtccttaggacagggggtggggacacgagataagcaataaacaggaactgctgttattatcacccccacataatccgatctcagggtctgagtgtgccccaggcaaggtgtccacagccctctgcagaaggatgcccaagtgatcagctggcacaagaacgccacgcacagcaggtgttatgcaactggccacctattccaggcagaggatgccagatccccagggagaagggggtaggggtgcagcttcaaagttttctgccccttttgagttctccttggagacactttggaaatgaaacctcccggaaattgatattaggcctctgcaggctgagcttgttaaaatttcccaacaaacagagccaacagacgctctacaaggaagcaaaaacaagacaaaacacattggcagacccttttccatctgctcttggtagatggtattcctctaagaaaatgccgccacgagtttctccatggcttcttgagctggtggccaaaggatttaggttctctttgaaattataacttaactgggcctgctttatggcagggatatcactctctgaaatgtgtatatatatgtgtatgtatatatatacacatatatacacatatacatacacagggccaggcgtggtggctcacacctgtaatcccagcactttgggcggccaaggcaggtggatctcttgagccccaggagttcaataccagcctgaacaacatagtgagaccctgtctctacaaaaattaataaaaataaccaggcatggcagtgtgtgcctgcaatcccagctacccagggtgggaagatcgcttgagcccaggagttaaaagttgcagtgagctatggtcataccactgcacttcagcctgggcaacagagcaagaccctgtctcttaaaaatatattattattattatacacacacagacacacacagacacacacacacattacagatgatgagaaaatactctcagccaggttttcatgatacacaacttctcaaaaagcatcacaagcaggttagaattagggatttctttgtggactgtccaagatgttgaggaaatattggtttagaatttacctcatttaggccagaaatggtggctcacgcctgtaatcctaacactttgggaggccaaggccaatggatctcttgaagccaggagttttagcctggccaacatggcaaaatcctgtctctactaaaactacagaaaaaaaaaaaaaaattagccgggtgtggtggcacaggcctgtagtcccagctactctggaggctgaggcaggagaatcacttgaacctgggaggcagaggttgcagtgagccgagatcgtgcattacacttcagcctgggtgacagagcaagactccatctcaaaaaataagatagataagataaatatatataatatatatgttatatatataatatagaaactacagaacaagtgatctttgtatgtttccagaatataacagcgggacaggcataggatagacgttcccattgcaaaagggagaaattggaagggataaagaggtcaccagtcctaagcaagtgctaaatccagcaagacaaatcccattaggtttcaaggcctgagaataatcctcggtgactctcagctcattaacatacttagttctcagagccagactcaatgaggttacggcccgcatgttatgggtcaggaactgaggctaagtaactcactggagattatgtggtaaagaaggtccaggatcattgcttcagtctccaggatatggggaaggttctactcctgttatcccaaattttaaaatgtgggaactaaggctcagagaggttaagcaaatcacacagggttgcacagctagtgatgttgctgagatttccctgtgtgtagtggctcatgcctataatcccagcattttgggaggctgaggcaagagggtcgcttgatcccaggagtttgagaccagcctgggcaatatagtgagacctcatctctacaaaaagaaaaattaaaaagttagccaggcgtggtggcaggcacctgaagtcccagctactgggaaggctgaggtgggaggattgcctgagcctgggaggtggcgattacagtgagctgagatcgcgccactgcactacaacctgggcgacagagtgagaccctgtctcaaaaaaaaaaaaaaaaaaagacattgccgagattcaaacccaggtcagcctgtcttctgaaatgtccctctatgacccactcacaaaactgagaaggcagaaagttgcttggacctgtctatttcccctgtgcagtctcagagaaacagtggaactgcctcggtttctccttccgggaagtattcatagaagcatcccacttacctactttggtctgaaaataaattagcttgtctctcttccacttactaaaaacaccgtgggtttttgcaagttaaaatgcaaaaataaaatgaggagaatggtgctggtagtttagccagtgggaagccctctggggaaagccagccttttatttattacttatttatttatttattctttctagatagatttatgggaaaccagggctgtgttgtccaggggtctgtagtccagaaggcatcagatgggctactaagtgagtctttgtccacctgtagatggcaagaggcagggcccaggtgtccatggcttggagaggcaggggttgatgggaggtttgaggctgtgggatctctcctggggcctcagtatcctcatctggataatggggacattctggccaggcacggtggctctatatatccagcacttagggaggcctataatcccagcactttgggaggctgaggtgggtggatcactgtaggccacgagttcaagcagcctgggcaacatggcgaagccctgtctctactgaaaatagaaaaactagctgggtattgtggtgcacgctggtaatcccagctattcgggaggctgaggcacgaggatcacttgaatccacgaggcagaggttgcagtgagccaagatcctgccactgcactccagcctgggcaacagagtgaggctctgtctcagttaaaaaaaaaaagaaaaaagaaaaagaaagaaagaaaaagaaaatgggggtattcatttatcatttgacagtaagtttacccagcattgactgtgtgagaggccctgtactaggcagtgaaaactcagctaagaataagaaagttaaaaacaagctgggcattgtggtttacgcctgtaatcccaacattttaggaggccgaggaggaagaatcacttgaggccaggagtttgagaccaccctgggcaacatagtgagacgccagtctctacaaaaaattgtaaaattagccagacatggtggcgtgagcctgtagcctcagctacctggaggctgagatgggaggatcactggagcccagaagttcaaggctgcagtaagctatgatcctgccactgctctccagcctgggcaacagagtaagaccctgtctgaaaaaaaaaaaaaaaaagaggccaggtgcagtggctcacacctgtaatctcagcactttgggaggctgaggtgggtggatcacttgaggtcaggaattcgagaccagcctggccaaaatggtgaaaccccatctctactgaaatacaaaaaattagccggtcgtagtggtgggcacctgtaatcccagctactcaggaggctgaggcaagagaatcgcttgaacctgggagccagaggttgcagtgagccgagatcacgccactgtacgacagagcaagaaaaaagaaagaaagaaagaaaagaaataagatgatggggagttgtggaaacctgtccatgggcacgtgaaggtcttgacctctgaccaagaagtgaacaggctcctctcaattccaggcactgcagggatctgggacatgacttctccatgaccaaactgtaccctttccttttcttttttgtttttttggtgacagggtctcactctgtcacccagactggagtgcagtggggcgatcacggctcactgcagcctcaacctcccaggctcaagcaatcctcccacttcggcctcccaagtagctagaactacaggcacacagcgccacgcccgtcaatttacacattttttgtagaaatagggtctcactatgttgcccaagctggtcttgaactcctggccttaagcaatcctcctgcctccgcttcccaaagtgctgggattacaggcgtgagccactgcgcccagcccaaattgtactcttgaaagatggaatcttagctaggatcctgaactgttgccttttatcctaaatcagttgttggttctttttcattcacttgccttcctcagagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaaggtgagaccctctgctctcacatcactgggcaggggacctggcgtccctggagccagaggctctgctgagtgaccctggactgtgaccccatctctctggcctcagtctcctcccctggaaaatgggcataggcgtagtttcctaccccacagggctgtggagggttcagtgagataatttgtgcacagtgcctggcacggggttgtgttcagtcgggttagcaatatcttctacgtccttccttcccaaggggagccaggaagccaccccatttgaggagcaatagggtcctctgatggaagcttgagggggtcagatgattgattctctcggcccagcactgtccaaaagaaatgtaacacaggccacatgcaaatgtcagtttaaactctctagtcgccacattaaaaaaggggccagatgtactggctcatgcctgtaatcccagtacttcaggaggccgaggtagagtgagccaagatggcacctctgtactgcagcctgggtgacaaagcgagactgtctcaaaaaaaaaaaaaaaaaaaaaaaatggtgaactgctgggtggattatgtcttaagttcatctagtgtcagttctatgtgagagattttcatgagtttgctggataaaggctttccatggtcctgagacctaagatcctaaggtcttgtcactgtgcccattttatagatgtagggactgaggctcagagaggctcagcctgcccgtgggcacataagcaggctgggctgcagaatggaagctccagaggctgatggctcctccccctgagtcaagagaggggtgctaatgggggcatgccatgcagtttatgggaggtctcagtatttctatctgttcagtgggtctcttggcactctccctacctgcctgcaagtgagggtgtgaaggtccaacgaggataggggcaggtctgtgttaatatcccatgagggccccaccgcactcaaggctatagagtggttgagagcaggctctcgggggccaggccgcctgggttccaaatgccagctctgccacttcctgctgtgtgaccttagacaagtcactttacttctctgtgcctcaatttcctcatctgtaaacaggagatcagaatatatcaacctcagggctatacaagggttcagtgatgtcataagatgcctggtatatacagcaggcactttagaaatgtcagccgcttcttgcctgccctgggagtacacaggagttcccagagacttgtgggaaattgtggagggagccctgtgttggttcttgtcccaacagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccgtgagtatggcccccagcaagggcagggggggcctggggctcccaccagggtggcggaagtcaggccagatagagggcaatgagtgagtgttgaccaccatgagtccagggatacctttgaacaagttgaaaatggatgctccttccgtaagtcaggtaagatgatttgtcacaatatactttgttggaagagacccctgtcctgccatccactagaaaatcattgttatttatgacaataaataaacaaatttgtcataaataaacaaataaatttgtcctaaacaacaaataaatttgtcataaataaacaaatcttcactgtgatgtaagaggcacccccttagaaatggctgccttgtgcagtacacagcctgaacaactgcacgtggcagccctaggacctgaactctgtttctaacctagactctgtaagggtttagattctgggcggatagtgtctgagttccatggccttctgtcttgggcatctttgaaatggatagactatttaggggagaaatttatcccatgaatgtcgtagtggctcggaggttgttttagaattgaatgtctcccagggatatttcttgaaagcctgaccgctcaaaatgcttcttgacaatgaaggatcatgtcagataagatgggggagaagctgctttctataatctgcctcttggcaactcaccctgggtagtaataaataaaagtacctttaaagtacttttttatttagttgacttatcgattttactaaggaaacacttatgtggtatctactcagtgccaggcactgttctgagtgccttaaaattttttttaatttctctgaggttgttactatgcttagctccatttgacagatgaaaaaactgaggtccagagacgtgaattcacctgcccaaggtcacacagcaagccagtgggagagctggagtttgagcccagacactggctctagcctccttgttcttaaccactcagctctgctgccattcacacaaccttatgaactatttattattggctccacttattaagaggttaactggcacatcccattggcacattcaaggctctgataaggcctgcaattcataatttcaataactaactttttggagcccctatcatgagccaggcataaattaagtcttgggtctcatgattttgtgaagtaagcactagtattacggctattttacagatgagggcaccaaggcacagaggggacaagtaacttgcccaaggtcacacagctaatttttaaaaagaaagaaagaaatctacttaacccatagattcacaatattgtttggccctgggacatttaatatcgaaaagcctttttatctcctacagaattaaggaccgtatttcttcaacctagcttggggatcaagatacttcaagagggtcgtttgggagtgataggaactttgctaaacagggcatgtgaatgtcttctctcaccgaggtcccctctgccttcttggggttccaggacccagagagggcccccacctggaggagtttaatagtttgttgtgtaggaggccttgggggttggagatctcagtagtggtaggtaacatgagattatggaagaaaagggtttgtgagcctgtggtctgagtggacctctgcacgcccatctgtctccaacagccttcgccgcctgtgccattacatcctgaacctgcgctactttgagatgtgcatcctcatggtcattgccatgagcagcatcgccctggccgccgaggaccctgtgcagcccaacgcacctcggaacaacgtgagtcccacagagcacaccccttcctagcctggctgctctgcctcaggccactttctcctgcatccaaaatgctcataggtagggtgggatgttggggtcacccctaggcatagcccttatggctgctggttgagaggggaagctctgattccttggggatgctcttgggagcaagacattccttgaggcagtttctctgtgagcctggtggggtggaggtggcccagagtgactggggctgaaaattgctggattctctaatggaggcgtgagactagcaggatatggatgttgcacattctctacatggaataggggggttactggggcaggggcggtgctcagaggtggtcccctccgcagtagacatttccctttgtacacgaagctttgaaagaaacaactatttggctcagaaacacagcctaagcttttggtttttatgaaagcaagcccctttgcggatggtgggtctgttgacaacccctgttaattgagcacttgctgtgtcccaggaagaaactcagcatgcagtatctcatttaatcctcacaatgcgcccccccaaccccccgcccaggcatccccatttgacagatgggaaaactgaggctcaggggaatgagagagtggtaagtggcctgtccagggtcacacagcagaattccaactctgcatcccccaaagctcccactgcttcccccaactgtctgcatttactaatcacctactgtatgctacggatgggtgtgcatagcccctttgagtcctgacaagcaggaatgagtgcatgcttgtggttgagatggggaaaccgaggcaccaacaggcaagggcgtgcctcagtcatgggctgcgggcagaggcttgaccccagggcctggtagagggtggactggtggctcctgtttccctccccagctccctcccccaacccttccctcccaacccagagccaaaaaagtgtgttttctgctggtccaaggctctgctgccctggctaagtaggttaggacccaggcaaagctggcgagccccatccctcaagcccgcccacagcttaccatgcactttcccttccttcccaggcctggcaggcccccctggggacctgatgggggagatggaaggaaataattagaacgcagctcctggaggaagctagagccagtgctcagcctcctcacagtccgcttagttgcttcccgcagcctggtttcccccaggggcctccaggagccaggcgtggggaggaggtgtccctggaggggtccacaaaccccctgctgacgcgaggatgctgaagaaggcgttgccttcggcagggagggcacaggcatggatgatccagggggcacggcagctcccagggctgaagggaatctaggcagtgctcagaccaggccccagggactgtttgcaaagagcgttcagctccccggccccctccctcgtccatctcgcagtcgaaacttctctacaagaacactgtggccccataacgttcacaccacgtaaccaccatccagggcaagaaatagaacaaaaacgccccacgcggcatgtgcctcctcgatcccccacccccaccgccttctttccctctagagctgctggggacactgtctggagacatttttggttgtcacgacaggaggggggaggtgctcctggcatctggtgggtggaggccagggatgttgctcagcacccgccgatgcccaggacagcccccactctagaggatgatccagacccaaatgtccacagagcccagcttgagaaaccctgccttaccggtaaccacgaccccagcttctggaatgagcgtttttggcttctctctttttcccacctgcacaggctttttttttttttttttttaagagacaatgtctctctctgtcgcccaggttggggtgcagtaacgtgatcatggctcactgcagcctcaacgtcccgggctcaagtgatcctcccacctcagccccccaggtagctaggaccacaggcatgcaccaccacacccagctaatttttaaatgcttgtagaaacgggcctcgctatgttgccaggctggtctcgaactcttgacctcaagcaatcctccctcctcagattcccagagctctggaattacaggcatgtaattccaattcttacatgcctgtaattggccaacactggccaattcttaaaaactgaatttatgtttgctcttctgtaacattcaataaatgagacacttctatgcttcgcattaaatgagtacatgttgcttttgcaggattgatgggcattcttttttttttttttttttttgagatggagtcttgctctgtcacccaggctggagtgcagtggtgcaatcttggctcactgcaacctccgcctcccgggtttaagcgattctcctgcctcagcctccagagtagctgggactacaggcaggcgccaccacacccggctaatttttgtatttttagtagagacggggtttcacactatcagccagactggtctcaaactcctgacctcaagtgatccgcccgccttggcctcccaaagtgctgggattacaggcgtgagccaccacgcccggtcaatgagcattctttatgatgctgttttgagatttactgtgtggcatgggatgtgttatccatcccctgttgacagatgtttgggttgtttctaagtgtgaatactgtccccatgccacgcccctcaacatgtttcctgagtcacctggacagtaatttctccaggaggccagatgcagtggctcacgcctataatcccagcacttcgagaggccaaggtgggagcaatgcttgaggccaggagttcaagaccagcttgggcaacatagtgagacccccacctctaccaaaaaaaaaaaaaatttttttttttttaattaaccgagcgtggtggtgcacacctgtggtcccagccacttgggaggctgaggtgggaggatcacttgggtctggaaggtcaaggctgtagtgatccatgttcataccactgcactccaacctgggtgacagagcgagaccctgtctcaataaataagaattcctccagggtataaaccaaaagcgaagtttctagagcatataatttgcaagtggttggcctcagtaaatgcagcttgaatgtttattggacaataaacacagtgaccctttgggaggccaaggcgggtggatcacctgaggtcaggagtttgagaccagcctggccaacatggtgaaaccccgtctctaccaaaaatacaaaaattatctgggcgtggtaacacacaactgtaatcccagctactcgggaggctgaagcacaagaatcacttgaacccaggaggtggaggttgcagtgagccaagatggcgtcactgcactctagccttggcgacagagcgagaccctgtctccaaaatatatataaataaataaaaataaacacagtgggccgggcacagtgggccgggctcgcacctgtaatcccagcactttgggaggccaaggtgggtagatcacgtgaggtcaggagttcgagaccagactggccaatatggtaaaacctggtctctactaaaaatacaaaaattagccgggcgtggtagcatgcgcctgtaatcccagacacttggaggctgaggcagaagaattgcttgaacccgggaggcagaggttccagtgagccaagattgtgccactgcactccagcctgggtgacagagtgagacaccatctcaaaaaaaaattaaaaaataaatgaacgcagtggcccttgcaccagtagctcatgggaactcctgttcttccacatccttgtcaacacttggtactgtcgactgtttcatttggccgatctgctgggtgtggagtgagatcttattggggttgtgcttggcatttccctgtaatgaatgagatcaagcacttttttggattagactgagccacaggaaataacattttcaaatagatgaaaaagatctaagtattaggaatacttgaacctaatttattggtcttttgatttcctcttgcacagcttattaagagctccagaattagattcacctgacccccacggcctgccctttcccagctccctctcttccttctttccttccattcattcctttagtaagtatttgataagcaactactatgtgccaggtactgagcgagccagggaggattgacagggtatgagatggtccctgcactcccagagcccacaaaccaccaggcctttgaccaggctgtgcccactgcctcgtgcacctgaaatactctcccaccaccatcccctctgcccacccaggtctttcaagccaatccccttgcaccagcccctccctccaggaagtcacctcaccctgaccccaggcactctggtctctgattcctcttcaagcaccacatataacaggaatataagttataaccacacagatcacagagcccagctcctccaggacccagtacagccccaactgttgatgcattcattcaacaaacatttcttgagcacctactgtattcctgaccctgtattataagctggagacgccatggtgacagacagacatccctgtccttgtggggctgacatttgggtgggggagatggacaatgagattatcagtaactacaacaaatgttcagggagtgataagtggccgggggtgtggtgggcagagggaaggagagacttcgtaaagaggatctcaagcaccaggagatggaatttaaacagccggtcaggggagtcctcactgggaaagtgttatttgagctaagtcataaaggaggagaaagacggaatcaaatgggatgtgggggaaagcattccagagagacagaacagcctgtgcaaaggccctgaggtggaagcatcttggggaacaaaaggaagtgagcaagggagagaatgagaggaagtgagggcagggagctgaatggtcagatcgtgcaggggcttgagggcctcggggaggactttgacttttatccctgaatgaggtgggagccacggaggattgtaagcaggggaaggatgtgcctgacttctttggtgttcacagcgccctctggtggccatgttcagtaatgctcagcccttgcagcttctgggtggatctgattttttttttttttttttttttagacagtctctgtctcccaggctggagtgcagtggcacgatctcggctcactgcaacctccgcctcccacgttcaagtgactgtcacgccttggcctcccaagtagctggaattacaggcacacgccaccatgcccagctaattttttatatttttagtagacacggggttttgccatttggttaggctggtctcgaactcctgacctcaagtgatctgcctgcctcagcctcccaaagtgctgggattacaggctcgagccaccgtgcccagccggtgtccaccccatgtctagcaccagccagacactgtgccggcgcaccctcatcttcaggcctgggtgacaccagaggtgtgctatggtgtgtcctggacaggggctgggccagaggacattgctcgtccaggcagaaacatcaggcctggggaggggcacaggaaaaatcaacctaccctggcaggggcctggccttgaagcaggaagagatgccgtggcaggaagttggccccagtgtttaaaaaaaccacgtagcaactatttctcgcccaggatgcccaggaaagcaagggtactgggggattagatccatcaccaagaaggatacagtcagccctgaacttctctggggccgcttctaatccactacagggcttggggcaaattttaaaaggtacccttcccgtgggttagcgaactggcctagtacagtgatttttttgttaggatttgctgccatctgctggacaatttcattcacaacatacaaatctgcagtatgaaaagagatgggaggggcccttgtgcagtgcacgccctgcgcaactgtatatagcagctgtgtttcctcttctgggtagaaactctgctccccagtaggcgatcgttagttttaccggggctctgctggaacaggccagtgatccactgctctcttgcttttatcccttacaggtgctgcgatactttgactacgtttttacaggcgtctttacctttgagatggtgatcaaggtgagtgcagattataagtgagaacacacggtaatttttttttttaagcaagtgcagggctgggcacagtggatcatgcctgtaatcccagcactttgggaggctgaggcaggcagatcacttgagatcaggaggttgaggccagcctggccaacatggtgaaaccccatctctactaaaaatacaaaaattagccgggcatggtggcacatgtctgtaatcccagctactcgggaggctgaggcaggagaatcacttgaaccctaggctgcaatgagccgatgtggaggctgcagtgagccgagatcttgccactgcattccagcctgggtgacacagcgagactctgtcaaaaaaaaaaaaaaaaaaaagagctgggattccaggagatcctgagcctccaagaatgccccccttgagaggatgagtctcccagaggattagaaatgcctggtgtgtttgaagagcagcaaggaagctggtgtggctgggcggagtgagagaacagtggggaaacgaaggacagagagatgagtggggaggtgagggggcaccttgtgccggggatcacagagagggctcttcggctcttactttgagtgaggtgagggccatagagtgttctgagcagaggagggacttgatccaggtgttcacaggtgccctttggcatctgtgggaagccagaggacctgtgagcaggtgatcacactggtccccatgggcgatgacggggacaggatcaggctggtgaccaaagaagaggtgagaagtggacagattcttggaaggttctggaaatagagccagtgagttttgctgatagagccaccaatgagggatttgggacaaagaggcatcaaagaggatcccaaagtttggatctaagagccggcaagccagagctggcttccatcaggcaaaggggggccgcctcatggggcaggggctccccactcctccctggagtcctctggccactgcccatccctgcaagatgaggtggcctcattggcttccctgcctctccccgagaggctagagagtgggtggcagcaccccagggtggggatcaggtgggggttctgagcaccctctcttctcccccacagatgattgacctggggctcgtcctgcatcagggtgcctacttccgtgacctctggaatattctcgacttcatagtggtcagtggggccctggtagcctttgccttcacgtaagtctcctcgcaagggttcctcttgcctcttttcccccaacccccagcctgggccacacatcggattacaggacatgttctcagggtctagggatggggtgtgtgggctccggggacgtgggagatatcagcatgccaccaggaagagcttcgatggctttttgcatgatgtccatggaggaagaaggagaagggaccccccctcctgccaaccttctacctcctcacacagcaacgggcctcagccacatcactggccccttgctgtgcagcttcctgtagactagcctcgccggaacatctcatccccctactactccacaagcgccgcccaaaccgctgtctctttggaaagtccctaaagagacaatcaggaaacgaatgtgcatgagaattctgaccccctccctatgcctgaaggccccgtagttgtagacctggtgactccctttgtgtgtctttcacttctcctggcagtcctaggattctctgccctctgaaaggccatgtgtcatcctgcagctccaagatggcgccccagttgtaggcagccatttcaggatggcacccaagctcttagtagtcatcccaagatggcatccaagttctgggtggccattccaagatggcccctgagttctgagctatcattccaagatggcctctgaatttggggtggtcattcttagatggtccctgagttccaaggtgaccttcaagttctgggtagccattccaggatggtccccaagctctgggtggctattccaagatggccccaagttctaggcagccattgcaagatggcccctgagttccagggtggcccccaagttctgggcaaccattccaaggtggcatccaagttctgggtggctattccaagatggcctctgatttctgggctaccatgctaagatggcctctggattcttggtggccattcttacatggtccctgagttccaaggtggccttcaagttctgggtagccattccaagacggtccccaagtcttggatggctactcgaaggtgacccccaagttctgggcagccatctcaaggtggcaccctagttctgggtaaccattccaaaatggcacccaagttctagggcaaccatttcaaaatggcccccaagttctgggtgactatttcaagatggtacccaacaggtgagtggccattagcccttagggccctgatagcagacttagcagtacattcctgaagttgtagacatttggagcgggatgaaaaatatctaatcagtctttaatcaagaaacaaatcttggggaccctggctgtgcccatcatggtgaatgattccctgacaggttttgaaaggatcttgacacattcactcccatcgtgagagaatcaggggcttcctcctgtgcctctgcctctaggctccctcctgagccaatctggaggggcccttgaatggtctccctcaccaaacaatgaggacttggtttgtcaggagggccaaaatagtggcccatttccagtagaagggctgttaagtaggccacacttagattcttctctgggaacacaatgaggtcaagttgtgttagaacaaaaaatctccagagtttttggatgcctcagagctggagatgtatcatgaaggttgggaggctgattatacttctttctctttctctttcactccttcctcctctttctcctctctttttgttcgtttactcttttctttttctcttctcctctccctccccacatccttccctctcctcaaagcttttcagtgtctatttgactactagagcaatgcacggtggcttacacctgcaatcccagcactttgggaggctgagacaggcagattgcttgagcccaggaggccaagaccagcctgggtaacatagggagaccccatctctaaaaaaaaaaaaaaacaattagccaggcatggtagtatgcctgcactagcagctacacgggaggctgaggtgggagaattgcttgagcccaggaggttcaaggctgcagtgagccgaaatcgcaccactgcaccccagtctggggaacacaggaagaacttgtctcaaaaaaataaaaagtttaaaaaattaaaaatcaatgaatttgctatttagaatattatgctttatatggttactgaataattttaatagtgatgagtacaaaaaaaacaggtttagcaagctgttctgtaggttaaaaagtaaataaataaataattaattaaacaaaatacaatgcacatcaaattaggggacaaagattgtgacgaataagacaaggagtccatgtctttaaaatatgaaaagcagttacaaatcaataagaaacactacttctcaatggataaatgggcaaaggacataaacagaaatctgatagaatgctggcaactagtaaaaatggaggtaaatcaacccttggaattcagagaaatgtaaaataaaaacgagatacaattcattccctatcaagttagcactgttcccgccgcacccccacacacacacaaaaaatgatttttttagctaataaacagcatatataagaatgtattataataggctgggcacagtggctcacgcctgtaaccctagcattttgggaggccaagggagggggatcacctgaggtcagcagttcgagaccagcctggccgacatgacaaaaccctgtctctactaaaaaatacaaaaattagccaggcatggtggcggatgcctgtaatcccagctactcaggtgggtaaggcaggagaattgcttggacccaggagatggagactgcagtgagccgagatcatgccactgcactccagcctgggtgagaaagcaagattttgtctcaaaaataaaaaaaggaatgtattataataaaatatacttttctccccctctatcacctatttaagcaggtccttcaagttgtcaggtagacatcatgctatgagaaaatttaaatcctgaaaagccagaatgttttaccaccctcagcctggaatgaatccttctcctatggaaataacctacgggtttctccacccctctctgcctttcagccccttccctccctctcccctccttttctttctccctctttctcttcctcctttcccctctcttccctctctcttcttccctctctctgtctctttctgttcgtctttctccttttaccccctctcagtttctatctttttattttcctctttctctctctctctccctctctttctctctcactccctgcactgttgatgacctatgtccttgggtgatgtgggcctcccctggaccgtgtagcttggagaaagctgaccctctgtcatcggtctggcaacagggacttggcccccctaccctgcattctgatgaggaatggtattcagacaaaggcagatcccaggacacaggaggacatgctcaggcagggacccccgcccctttcctctggggcaaggtctgctcagcagcctccaagattcctagggctcaagaggtggcaggtagctcagggcactagggcaggcagtggggtgaatatgtcactcatatccacctgtccacacacaatgcttaccttggccacctgtgcccaggggaatgggttttatcctgtgaatcctcccagtgaccaccactgagtgtggcacagataaatggtaccaagcccaagctgttcaggtctccaatgtcactttcctctcagacctctgttgtagctgacatactgtaatgctgaggagggccgggcacagtggctcatgcctgtaatcctagctctttcggaggccaaggcagatggatcacctggggtcaggagttcaagaccagcctgggcaacatggtgaaaccccaggcaacatggtaaaaccctgtctctactaaaaatacaaatattagccaagcgtgatagcaggcgcctgtaatctcagctactcgggaggctgaggcagaagaattgcttgaacctgggaagtggaggttgcagtgagccaagattgcaccactgcactccagcctgggcaacagagcaagactctgtctcaaaaaaaaaaaaaaatgctgaggaggtgactgtcccacctccatcctccgagttgaccatcacaatttagggaggggaatgacctacaaaggacccagaagcaagcctttcaattgttgagcttttgccattatgggccatcgtttacaacatgctgtttctaggttctctggaggtaaaattagcctcctcttttaaacaaagctaatctgcaaaagcgaaccaaaaattcttttccaccagagatcaattagcagaatgagctgggtgcgatggctcacacctgtaatcccagcacttggggaggccgaggcaggtggatcacttgaggtcaggggtccaagaccagcatggccaacatggtgaaaccccatctctactaaaaatacaaaaactagctgggtgtggtggggagggcctgtagtcccagctactcgggagggtgaggcaggagaattgcttgaacccaggaggtgaaggttgcagtgagccaagattgtgccactgcactccagcctgggtgacggagcaagactccatctcaaaaaaaaaaaaaaaaaaaaaaaacagcagaatgattcttttggggagttgactttttttttaatttctgagttttctttttaaatatcaagttatacaagggcattcaaattggcctacaactcacaggaatttggcagcctgtttgcagagtcaagcttttacattgttctcatgaaattggtacaggcataaagccacccttcactcttgaaaatccattttgaatgttgttgttttaattcttatgcaagaaaaggatctggatagggatttcaggccatcctgtcaaccctggcaggcttgtagatcatgcaggaactgggaggtgtgagattttgccagtaggatcctggcaagtgcctgggactctcccagggttttggaagagccgacggacatgagtccaacagggagcatctttatatcatggccgaagggatgagagaggagaccctcaaacctcacgcctaccacaccctccccaccccactgtcaagagtccatctggtactgctgttcctcccccagggcagggctgcaggcccagcacagctggccaggtgccttgatcaagccattcctgcacacctaagagccaaactgctagaaaaccagaataggagctactgcttttttccctaaaaagttttggaatcttctccccgttacaggtttctggcctcttttgcctgagaaggtctctcaccctatgaggactttgcttattgtctttccttgttatcggatagttggcacattggaaggagcatggatgctctgaggttctcagcctgagcgctgaactctccacccgccccccaccccccaccccagggtcctctgcttatttcctttctggtcttttaacttgctttgtctgtcctctgtgcatatcccctcatagacaaggctgagagccccacaagtattagattgaccttattgttttaagaaattgtccctccaggtctgtttgatttctctctagatgtgcaagtcctttagcctctctgtgcctcagtttttcccatctagatgaggaaactgcggcccagagggactgtggagggaagtaagtccgacaagatcactgaggttgggttcagctgtcagatgctacccatctcccagccctgaatacggaggctcacagtgagcagaatgatgctcagcagcctggccagcctgggttctttgaggcctggcagggctgcgagatccaggggaagggaataggggaagggagcataaggttattcccttccttgttgaaaggaaccttgccattctggcctgttggggtcaaagcaaggattcttcccccagtgctgtgattgtggcctcgtctccgatatgggagaaaactatccctgtggtcccaccaagggatgtattgaagctcttctgaagatgtccacccctcctgcacctcacccaaatatctgtgtgtgtgtgtcctgctcaattcactgactgtgtcccttgtatccatgcgtctaccataaacaccccatttcatgagccatcacacgtggtatcacgctctgtgcccatgcatcagggcggccaactgacatttctcagcagctggcagatcatgatcctgccctcaccgccaagagtccatctggcgcggctgttcttcccccaaaggcaggaccgcaactggcagagcgccttgatcaagctgctcctgcatacccaggagccaaactgtcaggaagccaaagatggagccctcaggctgctatctcttgatcctcatcttcaaaacagcccccacccctgaaggcattatttttcttgtgtatgatgaaatggaaagaagattagagtgcgagatacccacacctgggtttgaatcttagtctgtcttcccagctgtgtgcctgcccttgggcaggtcactctttttctctaggcctcagcttcctcatctggaaaatggtcataatggtgctgtcttcccataggcaaatgcagtgatgtccagaagactcccatattaaacctaaagtcagcagattaggcaaaaatcactgtcattgaaaactccctcaatcatccgtaaagaagctgggtgtggtgtctctcacctgtagtcccagctacttgggaggctgaggtgggagaatcacttgagccagggagttcaaggctgcggtaagctatgattgtgctactgcactccagcctgggcgacagagcaagaccacgtctctaaaaatataaaataaagccgggtgcggtggcttacgcctgtaatcccagcactttggaaggctgaggcagcctggcaacagagtgagaatccatcaaaaaaaaaaaaaaaaaaaaaaaaagtagaatctatatgattctacgtatgcaataattcctagatacactgaatttgagaaccccaagtcagactacaggaaaaggagatgagggggtgtggaggagaatccacttggaatatttgtagacatttaaaccattctgtgttttaaaaaatatcacagccgggcgcggtggctcacacctgtaatcctagcactttgggaggccaaggtgggcggatcacgaggtcaagagatggagaccatcctggctaacacggtgaaaccccatctctactaaaaatacaaaaaaaattagctgggcgtggtggtgggcgcctgtagtcccagcactcgggaggctgaggaaggagaatggcgtgaacctgggaggcggagcttgcagtgagccgagatcttgccactgcactccagcctgggcgacagagcgagactccgtttcaaaaaaaaaaaaaaaaatcactaacttccagaggggtcgtggatggaaaattccatagagtccgcttggcgacagggtttccgccattctgatggcggtcaagtctttctaacctggatctccagtcattgttgaaggcgcctaatgagccccaagcctgattccaatgaatcacgagaggaccagctgctaggtgctgatagctttccccaggcccgcatttgctcagagggcttcagagttgcttctaattccatcccaagtcagaactctttgctgaccccctccttcataaagagcaaagccaaggccatagcttttgttaatcaaacatcagaattccacagacctgagttggttggttgtttgttttaagagacagagtcttgcccaggatgcagtggctcacacttgtaatcccagcgctctgggaggcctaggcaggaggatcacttgagcccaggagtttgagaccagcctgagcaacataatgagacccccgtctctacaaaaaatggaaaaatttgcctgtatttccagctacttgggaggctaaggtgggagaatcacctgagccctggaggttgaggctacagtgagccaagatcccgctactgcactgcagcctgggcaacagagggagaccctgcctcaaaaaaaaaggagagaaggagagagacagggtctccctatgttgtccaggctggtctcgaacttctggcctcaagcaatcttcccaactcgtcctcccaaggtgctgggattatagctgtgagccacggcacccagtctgggcctgttttgcagatgaggataacgagaggcagagtcaggattcaaacccaggtcccctcaacttcaaagctcacaaccttttagacattctaaaaccttgcagctccacaacgcctggagaagaggggtttctccggctcttggcagtgactttccgtggtgaattcacctttggtaactgacagctttgcagctgtcctgctacctggaaatttggctttcttagtgctttcttgggcagtgccaggtgcctgccaagggcgggggactgaatggaggtgggggcggcttccagatggaaggatggacatcggccagcgccatgagcctgaggctcccccaactgctgcccgggcgggactcgggggtgctcaggggtgcgtgtgtgtacgtgcgtgttctgtgttcttttttctgaggccacttacgatctgtctctccctccgatgccacatcaccaggagcagtacacggtaaagtctctctctatctttctctctctctctctttctctctctctctctctcatattctgtctctcgtgatctgtcccctggtgcagcctcgttagttctgggcctgtttctgtggccttgtgtccttgctgccgctgtcctgtcgcttcaaatgaccagaactcactccctgcgaaggaggcatcccaaagggtcttgccaatgcctccgcccatgccccaccagttcttgcagagaacagaaggggcagaggttcagtttcaataggcaagctgggtggagcagttatcagaagcaatgaaagtgggccagacacggtggctcacgcctctaatcccagcattttgggaggccgaggcgggtagatcacttgaggtcaggagtttcagaccagcctggtcaacatggtgaaaccccatctctactaaaaatgcaaaaaattatctgggcttggtggtgcacacctgtaatcccagctacataggaagctgaggcaggagaatcacttaaacctgggaggtggaggttgcagtgagctgagattgcaccactgcactccaccctgggtgacagagtgagactctgtctcaaaaaaatatataaaataaattgaacaataaaaaaataaaatggccatggaatcgttttcagatgaggagatgcagaatgcccatggagacatgctcccaattgtcacttgtttgggacatcaagattttagccagttccatgtgcaacctggatgtacagttccttgactttttttctatcaacatgtattctaaagttcaatttcaaaaggaaactttagccaggtgcagtggtgcatgcctgcagtcccagccatttgggaggctgagactgaaggatcacttgagcccaggagttggaggctgcggtgagctatgatcgtgccactgcactcccccctgagattccatctctttaatttaaataaaaaaaaaggaaactatattatccacttacaaccagcattgctaacctaagataaatctgcaactgcaaaagtaaatgtaggccagacatggtggctcacacctataatcccagcactttgggaggccgaggcaggtggatcacttgaggtcgggagttcgagaccagcctgaccaacatggagaaaccccgtctctactaaaaatacaaaattagccggacgtgatggcacatgcctgtaatcccagctactcgggaggctgaggcaaaagaatttcttgaacccgggaggcagagactgctgtgagctgagatcacgccattcactccagcctgggtaacaagagagaaatgccatctcaaaaaaaaaaaaaaaaagtaaatctaacagaaaccagacaatgttgttgccttcaagctgggctctttgttaaaaggaaaattactaagtgttagggaggtgttaaaggcctattagcatctacctgaggcttcctttctcgcaaaagcagagcgtctgaaagatacgtggaaaagaaacttaaagtataataaaaaagaaagaaagaaaaagaaatgattatgcccctctgagatccaattatttaatctgtgcccctgttctgcctaaaattatctcagtgactgtccaacgtgtgtctcacacttgggggcacagccttgagatgataatgatgatgttagttttaaaaagaaaaaaaaaggttcagagttctgaatcctggagtatatctctgcctagcaggctaaaatacaattatcgtctttgttccctgaaaaatgaaaaaaatggagtcctttaaaaagcaaatggtgtgaagaatgatgtttttgcactggatactgagacccatcgtgatgggggtctctggggcagctctgctcatgacctgggaggtcactgtagggagatgttttctaggtgacctccccacccaaatactccaaccggaggcattcacgtgtcctgagaccacacgccaggcgcaggctaggggctaggacaagaatcaagattaaaggggaaatggccaggtgcggtggctcatgcctgtaatcccagcactttgggagtcaaggccagtggattacttgaggtcgggagttcgagaccagcctggccaacacggtgaaaccctgtctctactgaaaatacaaaaattagccaggtgtggtgactcatgcctgtagtcccagctattcgggaggctgaggtgggagaatcacttgaacccaggaggcagaggttgcagtaagccaagatcatgccactgcactccagcctgggcaatagagcaagactccatctcaaaaaaaaaaaaaaagattaaagggaaaatgaacacagagaagagtagattacactgtaagcctttgaagagttttctgtctaaaaccagagaccgaagaaacaaacaaagattaactccgaaatagcacataggagctggcaggagccagaggtaggcagtcaggaaatgctgtcggagggagcaacaggtaatttgggctttgaggaccgggtagttctgtgactggagaagtggaggaagggcatttctagcagcgggaacagtatatgcataagcagacagaggcaaaagaatgtggctggggcttgagatatgtagccataaatgggaatgcaaaggtgaaggtaagttggactagattttcaagagcattgaatgccatgcccagaagtttgcacttgctcttctgagaattcacgtgctccagaagaattctgagcaagagaaagagtgacaaggtcattggctttagccactgtgtgcataaaacatggaagaaaaggcagggaatgaggagcaagttgggagacgggtgaggggggatggcacccaggaatggatggcgggatgttaaggaaggtgacccactggggatggggatggggatagagggcaggcagttgaccatgactctcaggtttctggtgtggacaactggatgggtcatgagtgccatgaaccacaagctattcatggtcccactcaataccctcctcttggggggcctgagtcatggttggccaagggtgtcatggcatctctggggtctgcattgctaagctcagttccaacagaccttggactgaacttctgtgcagtcctctctggcaaagatgggctcagagacccttggagcaatgcagcagagaccatggcagcagccacatcagcatctgaaaacagcggcacccggttattttccctccttcagactcagggaatatggtgggggaggggagatttggtataagggccactttaagtatcttccagaatcccattggaagggggagaaaatcccatttttttaagagcccactgataccacctttaaaaagaatacacagggggccaggcgcagtggctcacacctgtaatcccaacactttgggaggccaaggtgggtggatcacctgaggtcaggagttcaagaccagcctggccaacatggtgaagccccatctctactaaaaatacaaaagttagctgggcatggtggcacgcacctgtagtcccagctacttggagaggctgaggcaagagaatcacttgaacctgggaggtggaggttgcagtgagccaagatcataccattgcactccagcctgggcaacaagagtgaaactccatctcaaaaaaaaaaaagaatacataggggaccactaaactcctagaccaagggcttttttgaaaatagctgtgaccaggtgtagtggctcacacctgtaatcccagcactttgagagggtgaggagggcagattgcttgagctcaggagtttgaaaccagcctgggcaacatggtgaaacctcatctctacaaaaagacaaaacaattagccaggcgcagtggcgtgtgcctgtagtcccagctacttgggaggctgaggtgggaggatggctttagcccaggaggcggaggttgcagtgagccgagatcgtgccactgcactccagccttggtgacagagccagaccctgtctcaaaaaagaaaaaagaaaagctgtgcagaaatgggggtggggaatcagccaacccccttgtgctgggtctcagggacacccaatacagctgctcaggcccagccagatggcaaagggccctcaaccaaccctgggaccagaaccacaaaaagccacgtacttactggctcccgagcccaagcttaacaggtgaaatggaccactcttcaccaggaagggcagggctgtgccaagctcaccccagacttctaggcctgggagggtagggtcccatggagctgtgggctgccccctacccaacctgacctctgcttcctctcttcccttcttcccacctaaacattcctccacagtggcaatagcaaaggaaaagacatcaacacgattaaatccctccgagtcctccgggtgctacgacctcttaaaaccatcaagcggctgccaaagctcaaggtgagattgggagatggtggggtgcggtgggggggactgtcagggttatcatgtacagctgagcaggttgtacactgctcaaggacaacacattaaaggaggtgctgataacatcctagccatcgtgtatggatatttgtattattacaacttcccagcagatggcagtaaagtgagctgacctaaaataatctgtgtattatggcagtttttctttagatgaagtgtcttggggttaagatcctttttcctaattcgcatgaaggcatcatatggatttaaaagggtataaccgtgatctgggaagcaggaactagatttcttgttccataaaattttgacttttcatctacctattctaggctctagtatctcccattccaaaatagcatgaaccagcatttcccaaaagcctgtcattcaaaaacatatatatatattaagggaaataaaatccagtcattagagcacccactttcactctatgcttcacctgggggtccccagtattatctcttatgtaatatgtttctttaaatcaagtcacacccgtaatccctgcattttgaaagaccaaggcaggagtgttgcttgagcccaggagaatgagaccagcctgggcaacatagttagactctgtctctactaaaaattaaagacagaaaacagatactgttatggaaatctaaccaaatatggctgcctgcctaaggctttgtgcattgacaactgctctttcttggttaaagagggaaaatgtcaatggtaggtgttaacatggtagcaactaagtaaaaatttctccttcactcaaaaggattgagagagttggaaaggaagtaactttgttaccttgtttttctgtgttgggctcctgtatcacttaaaagcatctctggtatcccatctgggagttttagatccatagaatgccaggattgagtccaactcctccaacgcttatttctgaaagctggggggaccttaccctagtgacttgacttatgaccttgcctgtaaaatgggaatgatcatggcagtattttggtatgatgggccactggaggcagaaggttgggcaggtccccagcccctcatgctctctgtcaactccaccccacaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcggtgggtctccactttccagcacattcccattggaaccagcaggtgggcaggggggaagtggctagaggcattggccacttgggctcagagactggagaagtgatgagccttggaagtgactcagttgcaaccagcttggatcttgggtagaaagaaaaccggttttagaatttgagtcaccacccagagccacagaatgagtcataagcaaattgattgacctttcagccaccgcctttgtcatgtgagggatattaatacacatccacagttccttacttgaaatcgttacaggcagatgtgtttcaaagttgagaatattttgagattcccatgtgggacatgacaccctcagctgggtctaaggcagccctataatcaaacacaatatttctgccataaaatgtgtaactatttacatcaaatggggtaaataacaagtataaagagcttcatgtccaatcagatcaggtttcattaccaaataagttaggtaagaggccaggtgcagtggctcacacctgtaattccaacactttgggaggctgaggtgggaggatcacttgaggccaggagttggagaccaggttgggcaacataatgagagcccatcctacaaaataaattttaaaagttagcggggcatggtagcacacacctgtagtcccagctacccgggaggctgaggcgggaggattgtttaaacacaggagttcaaggctgcaatgcactatgatggtaccactgcactccagcctgcgtgacagagtgagaccctgcctctcaaaaatatatacatataggccgggcgcagtggctcatgcttataatctcagcactttaggaggccgaggcgggcggatcatgaggtcaggagatcgagaccatcctggctaacacggtgaaaccctgtctctactaaaaatacaaaaacctagctgggcatggtggcagacgcctgtagtcccagctacttgggaggctgagacaggagaatggcgtgaacccgggaggcggagcttgcagtgagcccagattgggccactgtactccagtctgggcaacagagccagactccatctcaaacaaacaaacaaacaaacaacaacaacaaaaatatatatatatatatatgtatatatatatatgtacacgcacacacacatatgtattatatgtgtgtgtgtatatatatgtatgtgtatatatagtgatattgttaccagtgtaaagtggcattttgcaacacatggtagcctgttgttatcttgatggctatttattgaaattaggaggatgccagatgtctggataggagtctggaactaacccttgtttcctgccttgaaaaggagtagcaacctcccttagcctgatgaacctctaaatgtcccctatgtctctctgcctcctcctaaactccctccaccccacccccagcaagcctgaggctctcaccctgaggactagaagttatcacgttggaagagggtgctggaccctgggtcagctctcccaccaggagtaaggttgtgccatcacccatggatttatctcaaagtagatgcacacgtcatcccctatgaagcacaggaacacatggtggcaggatggggagtcactgcttcccaagcagtctaggctggtggaccactcttcctttccctccccctgtctctgataaccaaagacaagtgcaagacagcccctctttcccatttactaacagtccccactctctgtggcagaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacagtaagtggcccgactggaaatctatccaggaggagccctggggagcaggaggataaagggcctgagagcttagcaataagaaaggtcttggaggccgggcatggtggctcacgcctgtaatcccaacactttaggaggccaaggcagatgtatcacttgaggccaggagtttgagatcagcctggccatcatggcaaaactccatttctactaaaaatcccaaaaaaaaaaaaaaaaaaaaaaaaaaaaaagctgccaggcatggtggctcacacctgtggtcccggctactcaggaggctgagacacgagaatcacttgaacccaggaggcagaggttgcagtgagccgagattgcaccactgcacttcatcctgagtgacagagcaagactatggcctccccgccttcaaaaaaaaaaaaaagtgaggctgaatcatggacttagtctttatttaaaattttgagccacttgtggtggctcatacctgttatcccagctactcaggaggctgaggtgggaggatcgcttgagcccaagagttcaaggctgcagtgagctgtgattatgccattgtactccagcctagacaacagaaggagacccctatccctgaaaaaaaaaaagaagaagaaattgatatttgttcatcatggactttttgcattaattttgattttttaaaatattggagcaaaagattatcttgattactgagattttcagtacccccttaatttgcacccaaaacaaatgcctccctccctcacctcgtccaagtaatggtctttctctcagaggtcttggaaatgccaggctggaagcttggtagattccagcatgtgccctcagcatcctcacctccctccctctctcagcaaatatgccaacctgaacatgccctactacccactctcagacacatccagtactcacacatgtgggaataatgctaacccacaaggcacctttgagcaaagtttttttaaacacctttctcaacagacttcatttccatctgtctgaaaatcatcgcaatagacttaaatgattttgttcaaacaaggcactgaaggaccacctgccaaaaaattgtcatcatgaatacacaaatctatcatgcctatcatgtgaaggtatcgcttagacacagagcctttgagcagtgtgcaacctgcactactgtacagagctgctgtgcacttacccactctcatatatatccccattgtacctcctgagcacccagcaccacctgtgctcaaatacccactctacatgcatacacccacctctactccctccattgccacaacctgtctttaaatcccaacttggccacttataagtgggtggtcttcagcacgtccctttaaattgctgaacctcaagttcctcatgtgcaaagtggagccagtaataacctccctgggagggttgctgagccggtggggatgaattgttgaatattgtttccagcacacagcaagcccttcatgcacagcagtagaaatgactgacattggccaggcgtggtggctcacacctgtaatctcaacagtttgggagaccgaggcaggtggatcacctgaggtcaggagttcaagaccagcctggccaacatggtgaaaccccgtctctactaaaaatacaaaaaaattagccaggcttggtggcgcatgtctgtaatcccagctacttgggaggctgaggcaggagaatcatttgaacccgggaggcggaggttgtagtgacccaagatcacgccgttgcactccagcctgggcaacgagagcgaaactccatctcaaaaaattaaaattaaaattaagaaataactgacattgttgtcagcctttcaaaaaacagcgactacttaaatttctttttcatttccctctgttcctgttctgccatctcacttccaccctctctccaccttcctcatcaccccttgggtccctgtctctctccttcctgccccttccctctccctgccccattccttgcagggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgaggtgccacttccaattccatctgtcctttaaaaactggggacacacacaaactttaaaacacacacaacacccaggaacccctttctaggggtacctgggggagggaacagaagcattgtcccaaccgaatccagtcttcagggcagcccttcatggagtttccagaggaaacacatcatatagtgtatgtatcagtcagtttagactaggttatgccgcagtaacaagcaaccccagatttcattgccaaatatccacaaagggacttattttttgctcacactgcatgtcaacatcagttgtggatcttgccatctttattctggttcccaggctggcagagcagcagagcagcctccctctgagatgctccagatgaaaaagagagtatgtcagactgaggttcagttcttcaggcttgtgctcaaaaattacacatgtcacttctgctcacatttcatcagccaaagcaagtcacacatccattctgacatcagtggagtgggcaaatacaatctcccctagcgaagggtggtgaatatttatgaatgaaaagccaagccaggtgtggtggctcacacctgtaatcccaacattttgggaagctgaggcaggaggatcacttgagctcaggagtttgagaccagcctggccaacatagcaagaccccatctctactacaaatcaaaaaaattagccaggcaggatggtgcacacctttagccccagtaacatgggaggctgaggtgggaggatgcttgagcttgggagttcgaggctgcagtgagctatcattatgccactgcactacagcctgggcaacagagcaagaccctctctcaaaaaaagaaaaggaaagaaaatccagtcccctgtctaccagagagtatagacatgactctttgcctctctggcatcatccaagctaaatagaggacctagaatatatcctctgctcccttgacccttaagacttaataaccactattcctccttctctctccctcaaagagaaggagaagacgcagcaaagtattcagtaagaaagaatgggctgggcgcagtggctcacgcctgtaatcttaacactttaggaggccaaggcaggaggattgcttgagcccggaagttcaagaccagcctgagcaacatagtgagaccccatctctatgattaaaaaaaaaaagttttaattagctgggtgtggtggtgcacgcctgtagtcccagctactcaggaggctgaagcgggaggatcacttgagtccaggaggtcaaggctgcagtgagctgtgattgcactgcactccagcctgggtgacaaagcaagcccgtgtcaaagaaaaaaaaaaaaaaaggaaggagggagggagggagggaaggaaggaaatgagagagagaaagaaaggagggagggaaggaaggagatagggaagaaggaatgaagaagaaagaaagggagcgaaggaaagaaggaagaagagagaaaggaaaggagaaaggggaaagggtggaaggaatgaagggaaggaaggaaaaaggaaagtgaaggagggagggaggaaggaaggaaaggagggagggaaggagggagggaaggagggagggagggaaggagggagggagagaaggagggagggagggaaggaaggagggaggaaggaaggaaggagggagggagcgagggagggaggaaggggaagaaggattaggcttcaatttgatttggcacactcggtagctgtgtcacctcaggcaagtggtttaacctttctaagcctctattttggtgatctgcaaagtgaggccattgatagtacccacttcccatgtttgtattagccatgcaataatggggaaatgtcagtgcaagttttggcagttggtgacatctcaagcaactgtagctgttgggataagaaagcaatggtgagaaggaagagagagcccaggaatcctggctgggggcaagagaggcagagactcaagcagaagcacttgagaaccgcgacgagttagacagagggtgcccggtgtacagccaccttcctcctgcctctgccgctctcaccactggcctctctcccgcagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaaggtaagtgccccacaccagcccccagcactacttaacccccacctcgttcctgcctctaccctgataaaatgaaaccatctgcagtttcccagacagaccacactctggatcacctctgagattttgttcctgctgttccctctacctgacacactgttcccaccactcccccggccagcttcttcttcccagctgtacctgcagacctcttcctccagaaagccttccctgaccacccaagactgcttgaggtgcccatcttagcaggcatcctatctttatgtcgcctgccacaaaaatctgcgtcaggttgcatgacagtgtcccccacccatttatgatgacctcagccctgaattcctagaggccaacaaggatctggctcagacggaacaagaagctctctataaatgtttgattaatgaaatgagggggctgggcgcggtggctcatgcctgtaatcccagaactttgggaggccgaggcgggcggatcacctgaggtcacgagttcgagaccagcctgaccaacacggagaaaccgcatctctactaaaaatacaaaattagccaggcgtggtggtgcgcatctgtaatcccagctactcgggaggctgaggcaggagaattgcttgaacccgggaggcggaggttgccatgagccgagatagcgcaattgcactctagcctgggcaacaagagcaagactccatctcaaaaaaaaaaagaaaagaaaaagaaagaaatgagggagaaggggtaggtgaggaccctaaaatccccagggctaaggagcggcttccaaaaaaaaactctgaaaacctttcaccctgtgctttggactccaaagcgtggattcaagcccagctcttccatttaattcatttacctttgtacaagcaaccagtgactttctggggactcagtttccctgtcaataaaatgggaatgataataagagcacatttgccccctccagaggaggtgagaggattgaatgagaaagttcatgcaaggaccttagctccttctcggcacttcaaaaacgatcaatagtggccgggcaaggtggctcacacctgtaatcccagcactttgggaggtcgaggcaggcggatcacttgaggccaggtgttcgggaccaactggccaacatggtgaaatcccgtctctactaaaaatacaaaaattagctgggcgtggtggcgcatgcctataataccagctgcgtgagaggctgaggcatgagaatcgcttgaacccagggggcggaagttgcagtgagctgagatcacaccactgcactccagcctgggtaacagagtgagactccgtctcaaaaaaaataaggaagccggggacggtggctcacgcctgtaatcccagcactttgggaggccgaggagggcgatcacaaggttaggagatcaagaccatcctggctaacacggtgaaacgctgtctctactaaaaatacaaaaagttagctgggcatggtggtgggcacctgtagtcccagctacttgggaggctgaggcaggggaatggcatgaacccaggaggtggagcttgcagtgagccgagatcgcgccactgcactccagcccgggtgacagagtgagactcctcaaaaaaaaaaaaaaaaaaaaagtataattcagccaagcacaatggcgtatgcctatagtcccgactatcaggaggctaaggtaggattgtgagttcaagcccagcctgggcaaaataggaagaccccgtctaccaaaaaaaaaaaaaaaaggttgggggaggtttttgtttttttggatgtgaaaagaagagcctagtccggcggagagcggggctttcctgaactgtgcctcctaccagtgaggttgctcagaccttgcctggggctggagtgttgcctggagaacagccatgaagctgcctccccacttcccacttcccacccctgctcgctgacccctgctactcctgcttctttcccctagttctatggggcttctgttgcttatgaaaatgccctgcgggtgttcaacatcgtcttcacctccctcttctctctggaatgtgtgctgaaagtcatggcttttgggattctggtaagtaccaccttggggctacagctatgggcttgggagaagcccaagggggaacaatgggtcctggatgatggtctcccaacgtggccccaagaaccccaacctcaagggtggcttcagtatcctgccagtggccacagatcctacttaggcattcttgtgtttgccaaggagtcccagggagacccaacctgtgagtgttaccatatggctgcttatgtatccagttcctcaaaatgatgggagtcatcatggctgggagtctttagcatccattttagagataagaaaactgaaatcaggctgggcgaggtgtctcatggctgtaattccagcactttgggaggccaaggtgggcggatcacctgaggtcgggagttcgagaccagcctgaccaacatggagaaactctgtctctactaaaaatacaaaattagccgggtgtggtggcgcatgcctgtaatcccagctactcgggaggctgaggcaggagaatcgcttgaacctgggaggcagaggttgtggtgagccgagatcacatcactgcactccagcctgggcaacaagagtgaaactctgtctcaaaaaaaagaaagaaagaaagaaaactgaaatcaggctgagcacagtggctcatgcctgtaatcctagcacttcaggaggccaaggcaggaggatcgcttgaagctaggagttctcaaccagcctgggcagcaaagcaagcccctgtccctacaaaaaaaaaaaaaatttttttttaattagccaggcatggtaactcgtgcctgtagtgccagttactcaggaggctgaggtgggaagatattttgagcccaggaggtggaggttgcagtgagctatgatcatgccactgcaccccagcctgggcaacagcaagactccatctttaaaaaacaaacacagaggtcaggcacagtgactcacacctgtaatcccagcactttgggaggcagaggcaggcaaatcacttgagcctaggagttcgagaccaccctggccaacatggcaaaaccccatctctactaaaactacaaaaaattagcctggcgtgcttgtgggtgcccatgatcccagctactcaggaggctgaggcaggagaatcgcttgaacccacaaagtggaggttacagtgagctgagatcacaccactgcactccagcctgagcaacagagcaagtctcaaaaaaataataataataaaaataaatatgtctttatttttcaccagccactaactaaattttaacatttccttccatcttaaagggagataacaaacccttagtattagtattatcaacccttaatattatcaacatgacctgtgtcacttataaacatcagatattttcatactgcattataagagctgcagataccttaacatttaatttgcattcatcattgctttaaaatgttgcttgtgattaaacctacagctagaatttgttactcagtgtttttttgttgttgttctgttttgttttgtttgagacagtctcgctgttgcccaggctggagtgcagtggcgcaatctcggctcactgaaagctccaccccctgggttcacgccattctcctgcctcagcctcccgagtagctgggactacaggtgcctgccaccacacctggctaattgtttgtatttttagtagagatggggtttcaccatgttggccaggatggtcttgatttcctgacctcatgatccgcccgcctcggcctcccaaagtgctgggattacaggcgggagccaccgcacccggcctactcagtgtgttaatggagaagtatattcattgttagatcgccatttttaaaactttttttttttttttgagacacagtcttgctctgttgcccaagctggagtaccgtggcacaatcttggctcactgaaacctccacctcctgggttcaagcgattctcccatctcagccttctgagtagctgggactacagatgcacaccagcatgccaggctaatttttatatttttagtagagacggggtttcaccatgttggccaggctggtctcgaactcctggcatcaagcaatctgcctgcttcagcctcccaaaatgctgggattacaggcatgagacactgtgcctagccttaaaaaatattttgatagctattttattacaaaaggtaaccttgaagcccttgctattttgttatgcatttacaagcctttatgcataaaataaaatagccagcactattctcacatggccaaggttcatagcacacacacaaaagtatagttggctgagtgcggtggctcacacctgtaatcccaacactttgggagacagaggtgggtggatcatgaggtcaagagatccagaccacccttgccaacatggtgaaaccccatctctactaaaaagtacaaaaattagctgggtgtggtggcgcatgcctgtagtctcagctactcgggaggctgaggcaggagaatcatttgaacgtgggaggcggaggttgcagtgagccgagatcttgccactgcactccagcctgggtgacagagtgagactccatctcaataaataaataaattaaattaaattaaattaaaattattttttaaaaaattgggggctgagtgtgatggctcacacctgtaatcccggcagtttgggagcttgaggagggcagatcccttgaggtcaggagttcaagaccagcctggacaacatggtgaaaccccgtctctactaaaaatacaaaaattagccaggcatggtggcgtgtgcctgtaatcccagctactcgtgaggctgaggcccaagcatcgcttgaacctgtgaggcggaggttgcagtgagccaagatggcaccagtgcactccagcctgggtgacagagtgagactttgtctcaaaaaaaaaaaaaaattaaggtgaagaaggcttatactagtgggctgggacttgaagtgaagtgaattcttgaaggtccccagtgagtggccaaggtgggacttgaaccaggacatctgttctcttgaccaccagcttagtccatccctttgaagagagtgacctacagtctgggtctcagccagggtctcaggaaaccaggttcccaccttggctcacggaggtggttaggggcatcagctttagcaccagagttcagatcttgcctcgtcctatataagctttgtcacctccccatcattaaaaggagccatcctccccctccacctcagcagagccctggtaaacagcaaatggactaacgtgcatctagagggttgaggatgaagcctggcctggcatgggcactcaataaatgctaggggccaggcacggtggctgacacctgtaatcgcagcactttgggaggctgaggcaggtggatcgcttgagcccaggagtctgagaccaacctggacaacatagtgagattctgtctctacaaaaagtacaaaattagcctggtgtggtggcgtgcacctgcagtcccatctacttaggaggctgaggtgagaggatggattcagcccaggatgtcagggctgcagtgagtcgtgattgagccgctgcaccccaccctgggtgacagagcaagaccctgtatcaaaataaataaataaatgctaggaaagggatcctactaatggacctttttcctccaaaacagtggctttcatttggtggagatgctacttattagaagcacttgaggccaggtgtggtggctcatgcctgtagtcccagcactttgggacttctgccaaggcagaagaattgcttgaacccaggcgtttcagaccagcctgggcaacatagcaagacctcatctctagaaaacattgaaaaattagccagcatagtggcacatgactgttgtcctaactacttaggcgaaggcaggaggattacttgagctcaggagttcaaggctgcagtgagctgcgatcacatcactgccctccagcctgagcaacaacacaagacccggactctaaaaatcaaaaaagaagcacttagggaaatttcttaaaattaaatgataccctgagcaaacccctagatgttctgattcatttggtttggtgaggtgggagggaatcactgaatctgtaatttattattatttttttttttttgagatggattctcactctgttgcccaggctggagtgcagtggtgcaatcttggctcactgcaacctctgcttcccgggttcaagcaattgtcctgcctcagcctcccgactagttgggattacaggcgcccaccatcacgcccggctaatttttgtatttttagcagagacggggattcaccacgtcagccaggttggtctccaactcctgacctcaggtgatccgcctgcctcggcctcccaaagtgctgggattataggcatgagccaccgtacctagcctgcagttattttattctgagttgatcttctgctggtgaagtgagtcttccactggggcctggagctgcatctccctcaccctgccaatcctgcaagagccagcactgagcttcccctctgctttctcttttttttttttttttttttttttgagatgggatcttactctgttgcccagcctgttcttgaactcgtggcctcaagcagttctccctccttggcctcccaaagtgctggaattataggcatgagccaccacgcctggtctcccctttcagttttaaatgaagccacaagttccctgtataacatttgggagatagaggggagctctctagcctaggggttgaggtctgtgaccaaacgcctataaagttgtctttgtttggactcccccagaagcagagcctgagacaaggattgagtgcaaggaatttatctgggatgcagggcagtaagggagagaggaagtgacacagggacagaaaggcaaccaggaaagagtgtattattaagccagttcctgctgtgaacaaatggggctcagtttcagtggatacctccaggaggcaacagagagcacataccacagagtcatcccacctcacagggagggaattggagtatttatcctccagtgcccatcagacataatcacaggccactcccaggggagctattaattccctaacacttgtgcagccacagagagaccctgggcaaagtagtgtacctcaggtgtgtagttgagctatgggcagggccccagcaacacctgccaaaatgccaaaagtgccagtgggacctgaattcctttttatttatttatttatttatttatttatttttatttatttatttttgacggagtctcgctctgtggcccaggctggagtgcagtggtgcaatctctgctcactgcaagctctgcctcccaggttcacgccattctcctgcctcagcctccggagtagctgggactacaggcgcgcaccaccacgcctgcctgatttttgtgtgcgtgtatttttagtagagatggggattcaccatgttatccaggatggtcttgatctcctgacctcgtgatccgcccacatcggcctcccaaagtgctgggattgcaggcgtgagccaccgcgcccggccccctgaattccttttttaggcagttgtgaaacaacaacatcccatctgttgggcacctactgtatattccatgctcagcgacgcacattcattgtctgattgctgtgttaccactgccttccagagaagggcgcagaggccccaggcacttcgcctaggagggaagcacagctctaaggtcaggctccttctctgtaaggtagaggggctacttcagggtcacactgaccgccccaacccctgacctggcctctgcttctgcgaagatgctgagaaggccctgtgttttgtgttttgggtcccactgaccccagaggggagggccatctctttgacccagactcttggatccaaactggggtgccacccatcaccatgtcagtacccggttgaggggagtcagagatagcaggagaccttgtgggacttgaggctgtgactgttctccaaacaatgtggagtatttccatattttaacaaaagagaggccaggcgtggtggctcacgcctgtaatcccagcactttgggaggccgaggcggatggatcacaacgtcaggagatcaagatcatcctggctaacatggtgaaaccccgtctctactaaaaaatacaaaaaattagccaggcgtggtggtgggcgcctgtagtcccagctactcaggagactgaagcaggagaatggtgtgaacccgggaggcagagcttgtagtgagccgagaacgtgccactgcactccagcctgggcgacagagtgagactctgtctcaaaaaaaaaaaacaaacagagaggttatgcttgtgtttccccttgagccagcacccagcccaggaatgcagcagtcaggatagatcaagtgaagctgcagtaacaaacagcccccacatctcagtgacttaaattgatgggaagggttttttacattcagcagggaagctgtttgcctcatagttacccagggacccaggctcacagagtagctgccattcaaaatgttactggtcgccaagcccagggttgagaggctagagagtccaacactgaccagaaagtgaccacactgcttccacacacagcacatcactgcacctagacacacatggccccatctaaacacaaggggaccaggaagtgcgtgtgcctgaaaggccccaaagccccgtccagtgcctgttctgcaccctgttactgtccgcctccagatcaggaaatggaggcccagagaggttaagccacttgcccatagccacacagctgtggtagcagagctgggatttgaacccagagtctcctttctttgcgagtatgctgccaacctagtggggacctgaacacagactgtgggctctctgaggcctgggttcaaatcctggctttacatctctgtgctgctagcctcaggcagatgagtggcttggttacctcctagaaaatgggtatacctgggagtggtggctcacgcctataatcccaacactttggaaggccaaagtgagcagatcacttgaggtcagaagttcgagaccagcctgaccaacatggtgaaaccccgtctctactaaaaatacaaaaattagctgggtgtggtggcatgcacctgtggtcctacctacttgggaggctgaggcaggagaatcgcttgaacccaggaggcagaggttacagtgagccgagatcgtgccactgcactccagcctggatgactgagcgagactccatctcaaaaaaaaaaaaaaaaaagagaaagaaagaaaaagaaaatgggtgataacccttccctccaggatcttcatgaggagctcagtgatgtcatttataaagcccctggggtctcgggagccctcaaaaatgctggagagacaggccacagctctgaagagcagccccagccctgtggagctgaagcagggtctggaggccccctctggggccaggccaatcatgggaaggcccccaggagttcccagggagggagactcagcacagatgatgtcgaacagcctttaccgcagcccttcgaacaaccataactgtcccgggcactccgctgatgggcaactgtgcctctaacatgcacccggccagcctagggggccgggaaccaagccctctgttggcatctctgtcttgtgggtccccattctagaattatttccgcgatgcctggaacatcttcgactttgtgactgttctgggcagcatcaccgatatcctcgtgactgagtttggggtaagtctccctccagcttctctctgggtgactctgggctggacgaggcaggcggcagggggcgggggagcggtcccagaggcagtgtgtcccggaagccatagctgcttgagccagcacttggccatgaccagagagggagaactggggccccggggacaagggcagcccctcaggagggcattgtggggagatgggggtaaccaaagcttggctgtagggccagcactgaggggtgggctttcctgcatcctggcctaggaattaataatgcagatgagtacactgagggaactgagacactcaaaagctctgaaagctgagccggctcccaaacaccaccctatgtcaggagcccagaaagaatgggtttcaagtcaattctgtttgaaccaaccctctcctagttagtgggcaggagagagccacagccctcaggccagtgtggggacaccactcccagggccatagaggggtccccagggtgtcttccctcctctagccccgggcctgggagactctcaacatgggagtctctggacctctctgtggtggccccacaggccacattgcccttctccttttctggaagactcagggccccagaggtcctgtcctagaccctctccttggccatctgccaatgagcccaggcttggggtccctcaggagattggggggagggtagaagatccttgcagggggaagcaatggtcaaaaaagggtgtcaaagccaagggtcaagggtgataccaatgtcatcttactaacaataaaaataacaatagctcacgagaatcgcagccttgctgtgtgccagggaactgtgccaagtggtttacgtggattggctcagggtagaggtcttggtctcagctcgtaagagaattccctcggagggttcaactgaaggcacccaaatgcagacctcactggtggaggggaagggaagggtacccacaagggtggcaaggtgtccagcgaccacccaccgtggggagctgtcacctgcccaggtgctgaagtggggagggaacctgagccggaggccaggagaagccaccaagtgggagctgtcctgtcaatgtggagagacagagaccagggcccaagcaggcagagagcaataggggagaaacaccccaacctttctctcccctcatcccttatctcctgccagagcctcccatggcccaaagtaaaccggaagcaagctgaatatgatgctcagagcaggcagggaagtcaggagaatagatctgggtgtggtcgggcctgaggaagagggtgttgcctcatttcacagatgggaaaactgacctcagctgggcacggtggctcatgcctgtaatcccagcactttgggaggccgaagccggcggatcacctgaggccaggagttcaagaccagcctggccaacatggtgaaaccccatctctactgacaatacaaaaaaattagccaggtgtggtggtgcatgcctgtaatcccagctactcgggaggctgaggcaggaaaattgcttgaacccggaaggcggaggttgcagtgagcgacggtcataccattgcactccagcctgggtgacaagagcgaaaactccatctcaaaaaaaaaaagaaagaaagaaaactgatcttcaatgcctggggaagtgagagacactcccaaggtcacaaagccaggcctgggtgactcctgagagtacactgacagctcctggggtgtcccagtcagatccccctacagaaaaggatctgtttgcctgctcttccgtcctagaaggccaggaggggctggggaactacacaaaagagggggccattctttgatatgtcctacggcacccgcacccaagtgatacacacttatttgccttcagctccagtgagccagaattttccccttcccctcaccctatccctgaaaccttcctctagagggttcttgcccacatgggggctctctccactggggtgcccccacctggtcattctcccctgtcctgagtttctagagagggctggagctccagctggcaatcaaaatatcttgccatccggctacatacaagacagccttgaaccaatgtccctttgggtcaagaggttagaaggatggtccagctccccagaagggcaggtggggtggaggaagttagctgaaaccttcaatcaccagtaagagagctgtagggacagactccaacagcctgttctcctggctggcaggaagatggggcatggggtgttcatgggacatcaggacccttgcagtagccaaacagcccccagccctccctaccagctgtttgatcttggacaacttgcgctatctcttctcatgtagagtggggctaaccattgcaaccaacctcagacacttgcaagactcacagtgatgcatgcactcaaaagacattcattgagcacctactgtgtgcctggtgtgattataagtgctggagacagaacgagaaggaggggtgccaaacaaaacagaccaagaatacagagtgtctgctcccatagagctgacattctaaggagagagacgggaactttttacaagtaaaagcatcaacaggccgggcatggtggctcacgcctgtaatctcagcactttgggagaccaaggcaggtggatcacttgaggtcaggagttcgagaccagcctggccaacatggtgaaactctgtccctactaaaaatacaaaaattagccgggcacggtggcaggtgcctgtaatcccagctactcaggaggctgaggcaagagaatcacttgattctcaggaggcgagaggttgtagtaagccaagattgtgccactgccctccagcctgggcgacagagtgaaactctgtctcaaaaagaaaaggaagaaaaagaaagaaagaaacgtgaagtgcttggcacagaacctgccaggaaaccaggagtttgaaaatggtggttgttaactattactgctgttgttattgttattgtgaatgggtgtgtagttttgttagccagccctgagttacagtcaatttgagggaaagatagggggtgggtgtttgggtccttctgggacaattaactcccaacctggagtagggagaggcatgtcctggcaggcaaggaggtctcagttgcccctttctgcctcccaggtaagcccactagttctgaggccagggcttggccaggctgagacaggaaatgccagatgcttgggcgggcaggtccctggggtttagggggcagagggcatgcggcagtactaaccagtgctgtctcagctgctgcccccaagtggctggggtgatgtgggtttgccctgtgtgcaatggataatgactgtgtttcttgtcttgtctcttttcatgcctgctcttaaaactgtatattggcgcaacgccgtctgaaaaactcatccaatcaaaatgcactatgaaattcatttgttcatccatgacatggtctgtgtgttcatacaccaatgacttatctcccaacccaccgccaccaccacccccactccccgcccgggaaccgaaacccattggttttttggcactggttacaaatcaacctaaaaaatgctgaacacgcctccccaactgcccccgcccgcccgctccccctcatcttcaacatctgcatctagaatccggttggtcttacttctttctgaagtctaaatgccttacattaactgtgaacgcatctcctcgcgtcggcattgcatgccacaccctgcctctccaacgtgggatgcctgacgctctcctcaaccctccgctctcctctgtctgtctgtcctcccgcccccagcccctgtgcctcccacttcctgtagactctgtctctctgtttttatcgggttctgaatgggggttttctgtttggggtggtttgcgtcttttgcagagaaagggatgggttttcccagcgcagcacctctctcttgccccatcccgcacacacatcccctacactcagagacaatagaggcaaatccactcccagccacctctcaccactcctgtcccccattcagctccatggaccccaggccccaggaaagctgccaactgtctcctcgcccctccagctctctccatcctgctgtccccaatcctccatctcaagcccacaagatctttggccttgaccagcagagacttgactctccaagtctgataaaggagacctgaaggccaggcagtgtgccggcaaagactctcaggcagaggaactcagaagtgccagacttggatctggtagcttcatgtggggctggcccactgaggccctctcctggagccttgaactgtacgtgcacacgcagtcacacagtcactgcacacagacactgcacacacagtcactgtgcacacactcagtcactgcgcacacactgtgcacacagtcactgcacacagacgctgcacgcagtcactgcagtcactgcacacagtcactatgcacacacagtcactgcacacagacactgcacacacagtcactatccacacacacagtcactgcgcagacactgcacacacactgcacacacacaatcactgcgcacacacagtcactgcacgcagaaactggacacacagtcactatgcacacactgcacacaccactatgcacacacactgtgcacagtcactatgtacacacactggcactgcatgtagtcactatggacacacactgcacagtcactgtgcacacatacactgcacacactgtcactatgcaaacacagtcactgcacacagtcactatgcacacacactgcacacacagtcactgcacacagagccactatgcatgcacacacagtctgcattcacacattgaacacacagtcgctatacacacacagtcactgcacacacagtctatgcacccacacactgaacacacagtcactgcatgtacagacactgcacatagtcatgacctcttctctttttctcactcattctccaattctctctctctctcgctcttttttttttttttttttagacagagtctcgctctgtcacccaggctggcgtgcagtggcacaatgtcagctaactgcaacctctgcctccccgtttcaagcaattatgatgcctcagcctcctgagtacctgggattacaagcatgtaccaccacgccaggccacttcttgtatttttagtagagacagggtttcaccatgttggccaggctggtctcgaactcctgacctcaagtgatgcacccgcctcagcctcccaaagtgttgggattacaggtgtgagccactacacctggcctctaatcctcattcactgttcctgtctctgtgtctctcacatacagtcatgcatgcatgcacgcatgcacacacacacacactggccctctctgctacatctacccaccctgtacccccactccagtacatactgcacacatctctctccctcccccacttctcagccccttgcacaccccttgttctgttaaatctcaactgcctctgcccctctcctacccaccaatgaggcccttagagggacgccccaatggcatctttgccctggaatcatcccttccctgctggcaatacacatgcattcacccaccaaacatttaatgagcccctatttggtgccacagatggaattatgggcagaagcagacaccattactgtcccctcttaccacatacagtcaggtgggggaggcaggcatcggtcaaataaccccttgactccacttaaaattatacctgcactgcgagctgaaggatgagcagcattaacaaggcagagagagatgcacagagcattccaggcccaggacagcacatgcaaaggccctgtggtgggacggaacctgtgaggggtcaggatctgcaagcgagggaatgtggctgatgcaaagacagccgagaaaggctggcctggagacagccgaagaaggcagaaggggacaggacccggggctggggagggcggggctatattgtggaatatgggctttctcctaagcaccaggaagggcctgggaggataggaagcaggggaggcgcgactggtcatgtgactagacaagctcgctctggttgcagggcagggaacagcttgacaggaggctgggctggaggtgggcaccaggaatcgcagcaagagatgacagtggaggagagagaacagtgggagggttgtcctctgcaggacccagggaaagatcaggtctgaactgagatgaggtgcctgggagcagtcgggtctggcttaaaactgggagataggctgagcacggtgactcaagcctctaatcccagcactttgggaggctgaggcaggaagatcacctgaggtcaggagttcgagaccagcctgaccaacatggtgaaaccccatctctcctaaaaaatacaaaaattagccaggcgtggtggcaggtgcctgtaatcccagatcctcaggaggccgagacaggagaatcacttaaacctgggaggtggaggttgcagtgagccgaggtcgtgccattgcactccagcctgggcaacagagtgagactctcttaaaaaaaaaatactgggtgatagaggtgagcgagtgcaaggaaaggaccaggttgggggaagagaataggtgtgggcatagcaagtttgaggtgcctttaggacatcccgaaataagtcagataggcaggtgttgtgggggctgcagcttggagctgaggtctacaagtagtaggacttttctggagcccttaggtgggtggtctccatatccttctgagcacttgaggaacatctgagcacagcactggaaaagaaaagaccacaaggacgctgtcctcatgtcttccaggggctgtgtcccacccccatcacattctagccaggaagttcaggggaggtgttgaagagaggaagctgcacctcccaagccatggattgaaatgtggaaggcaggaagagggaacttgtcagaagttctgggggcagtggaaagaattggtactgatgcaggaagagatggagggtggatgagggcagactagtacccttcccccactgccccaaacccttcccgtctccacccctacctgcctcatgtgtctcctcccccacttggctccaagaagggaagcatgttttctgcacgcatctccctgccagatccctggcttttttgcatggttgcaagcttcccctgctctcctccaaacccccctcctgaggctgcttccagggtccgcctgccttcgcatgcctggccgagtccacatgttatgatccgccccatgaaagggatggcttgtactctggggttgaacgggagggggctggggatacctgagccatcggccccatccccaggtggagctgggtggccaggcagggatgggggtcagggcagcagggcacagagagtgactctgttagccaagctgggtttggggcttgttcgaggcactggagacattctcacagcacttgagcccagtgtggtcagggtaggatcccccagcccccttccccatcctagaggcctaaggacgcactgatgtgtcccagagagcatcctagacattgccatcaaacccagaggcctcagaaattccttgaactccagtccttgcctctcagctcccaggccaaagccagcacaagacacagatctggcagccagaaagccctctggaagccaccaagtaggatgcccatgtcacccaaactaggacacttttgaaacaggagggaggctgtgactgtatggtcaccctgtgccatttggggggtgaaggttagaccaagttaaatcttgctacgtggcctgtagcaaatcctacaaatcccatagaacaagtctgattaagccccttcccttagtgtggagagaccctctactcctcctgccttcaccctgctgggtactggccagcgaaggagggtttccatgtctgcctgaggctggggtctcaaactcaaatgcctctgggggccaggcagacaccagtcaaccaggaaagcaagtgccatttctaaaacgtgaggaccctggaaaactggagatcatgtggcctgcttccagggagcaatcgcagcaggcctggggttgccagaaagccagattggtgggcaaaatctcttgatttttaaacaatggcaataatttttaattaaaaacaaggacaaatgaaaaaacactgctcgggcccaacaaaacagttttattagctagatttggcccactcgtgacttcgagagtcccaccccccccaccaaggtcccttgaagccccacaatggccacttaactctagctggtctcctccctgactctccaactctctggccccctggttcttctagcttgggtgggaggaggcagaggcagtgactagacagggggtttttgagcagaggcagtggccacccagggaggtcctgggggcagggatggccccacctcccggcccccagcacccgccccttggtgggcccgggctgatttctgagctcacccacccatgggagctgagtgcttcctgcttcctgcaggcctggtcccgtgctactccacccagccccagaagctgagaagccatccctgagaggggggaaaagggccccaaatgcatcttctccgactcagcgggcagcgaggactcaccctgcagccgaacagtcccagctccctcccgtcctccccattcccgctcgccaagggggtaagaaaagatgctcttccgcttctcccaattggctcgagccgctgctcctcttggccgtggggtgaggtcagggcgggcaggagcgggtgggcagctcggcagggcagggcagggcagggtgcccggtgagtcccgtgacagatgcatttctggcccggagcgtaacatgccctcggaacccgcacatgtccaccaggcctgactgtgctggcgacctccacccccacccccgccctggtgtttgtgcatcgtacacgtatgatagattccgcaacttgaccggcttgtgtcctttcgtctcagtgcatttggttgttgggagaaacaaaaaccatctcgatttttttcctgattggatgattcggatatattttctttttcttgttcttttgttatttcttccccatccccgttcctttttcctcctttctttttcttttcttttccccattgtgggtggggctggcagggagggcttatgcttttgagttgatgccttttcctccctcccaccctctctctcccaacattattcctttttcgagtttttcctctgcatcattgcattaatagtgctttctctctccctccttatttggggtctggcttgcttttttcctgttggttggcttcatgtaggggcctctgtgagtggtgacagctctgagccttttggggtgggtggatggtcacccctcttcctccatctccccagaataacttcatcaacctgagctttctccgcctcttccgagctgcccggctcatcaaacttctccgtcagggttacaccatccgcattcttctctggacctttgtgcagtccttcaaggtgagtcctcgtccctgctgctggcccagggctgagaagacaggtgaccctcatgctctggctgaatgtagaagtcagattggaagtgcctctgtgatgtagtcgtgcagagaatctgttatctccaaggctgttgtcaaacttcctgtccctggtgtgtcttcagagctgtaagggcctcatcctagagcccccagagatgcccaccagccctggaaggactctggcacgtggcatatggccacccaacccagtggggcagagcactgggacaagggaggaagacagtgcggctgagggacccccagcactcttcttcattgccttttttcccaccaggccctgccttatgtctgtctgctgatcgccatgctcttcttcatctatgccatcattgggatgcaggtgagtgtcgtgtccctaaggttcccagagcctcccaaggagggcagccacccttagaaaggggtgggtcagaggagcctggttcacagaagcagccatggaggttgagctgggtttcccagaagccactggaggaatggcagcccctggtcgtcaccctccaattccacaggtgtttggtaacattggcatcgacgtggaggacgaggacagtgatgaagatgagttccaaatcactgagcacaataacttccggaccttcttccaggccctcatgcttctcttccggtgagaaggggacctgctctgataattctgtttccgtggggtggggtgcctgccttcatccttctgttcccatagaggatgtaccctcctcttccaatgcaagacgtgccctcctccttctcttctggcaggggcgcgccctcacccttcttttccggtagggggcgtgcccttctcttccggtaggggacgtgccggccttctcttccgatagggggcgtgccctcctcctccttttctggtgtgggggtggccagatgtgctcttatccttcttttcccgtgaggctggaaatgggtgtcgtggggggcccaggaatcctagcagggcagaagcagagggccctgggacatagtcatcaaggtcattttccaggcattatctctgaatcttcctgaccaccctgtgaggaagggattcttggcagccctatccgacaaataagaaaacaggcttacagaccgtgaggcttgattctttggttcatcatcttggctgcacacaaaagttccttcactcgttcagtgtaggttttttgggggggctttttttttttttttttttttttttggagatggagtctcgctctgttccccaggctggagtacagtggcgcgatctcggctcactgcaagctccgcctcccgggttcacgccattctcctgcctcagcctcccgagtagctgggactacaggcgcccgccaccacgcccagataatttttttgtatttttagtagagtcggggtttcaccatgttagccaggatggtctcgatctcctgacctcgtgatccgcccgcctcggcctcccaaagtgctgggattacaggcgtgagccaccgtgcccagcccttttttttttttttttttagatggagtctctctctgttgcccaggctggagtgcagtggcgccatctcggctcactgcaagctcctcttgtggaggtgtattgagcacctacagcatgccaggcagggctgaaaaacgaggatgcaccaggaaatagagaaaagagacattttaagcactttggaagctaacatccccatggggaagacgaataatcaggaaacaaattatagaggatgctggaaaaagataaaattcaagaataaaggggaatagggccaggtgcagtgactcgtgcctgtaatcctagcattttgggaggccgaggtgggaggatcgctttagcccaggagtttgagaccagcctgggcaacatagtgagaccccgtctctacaaaaaaattgtttttaattaactgggcatagtgccacacacctgtagtcccagctacttgggaggctgaggcaggaggattgctcgagcccaggagttccaggctacagtaagctatgattgtgccactgcactccagcctcggcaacagagcgagactctgtctctaaaaagaaaaatatatttttttaatttttaaaaaaagttacagaggtagatagtggtgatagttgcataataatgtgagcttacttaatgctactgaattgtacacttcaaaatggttaaattgataaacttcatgctgtgtgtattttgccacagtaaaaaataataatgtttttaatctaacaacaaaaaaagaatagagggccggcaggttatgcctctctgaaagtgtgacatttgagagaaattggcaagggagggagtcagtgggtatatggggaagggcaggccaagccgaggggactgcctgtgtaaaggccctgaggcaggagtatggctggcatgtttgaggactgtgaggagcccagcatacctagaacagagtgatctagggagaatatagtatgagatgactgtcaccttcatggaggggagcttttttttttttttaatctgagacagagtttcggtcttgttgcccaggctggagtgcagtggtgcgatctcggctcggcgcaacttctgcctcccaggttcaagcagttctcctgcctcagcctcccgagtagctgagattataggtgcccgtcaccacgcccagctaatttttgtatttttagtagagacggggttttgccatgttggtcaggccgttctcaaactcctgacctcaggtgatccacccgcctcagccacccaaagtgctgggattacaggcatgagccactgcacccggcctgaagggagcttttttttttttttgcttttttttgagacagaatctccctctttgtcacccaggctggagtgcagtggcgcgatctcagctcactgcaacctccgcctcctgggttcaagcgattttcctgcctcagcctcccaagtagctgagactacaggtgagcgccaccacaccgagcaaatttttggtatttttagtagagatagggtttcaccatgttagccaggatggtctcaatctcctgacctcgtgatccacccacctcagcctcccaaagtgctgggattacaggtgtgagccaccgcgcccagccaagaggggagcttttaaagcataacagtgaccagcctgagcaatgcagtgaaaccccatctctacaaaaaaaaatagtttaaaaattagccaggagtggtggcgtgtgcctgtagtccccagctactcaggaggccgaggcgggaggatcacctgagcctgggaagttgaggctgcagtgagcagtgattgtgccactacactccaacctgggtaacagagcaagaccctgtcaaaaaaaaaaaagagagagagagagaaaagaaaggaaaagaaagagagagagaaggaaaagaaaagaaaaaaacatatcagtgtcctcaaatcccaccctagaccaactgaatccaagtctgctggggtggggcacgggcattggtattttttcaaagctctctgtggacttcagtgcacagccaagaatgtgaattcccttctctcagctcccagtaaaaggaggtggtccacctggggcttgcctggccagctccagagcccaagtgctcaacgtgtgtgctccacctcctggggaggcgttggtacccagtcagggctgggtgtccgagtctctgatttctccctgtcctcaggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctggtgagtctgtggacactgtgagggccgtctgggctccctaagcctggcttcctttcaggggagtgggtttctgtggaatgtggctgtgtcgaaggcttgttccctccaaggcttctctgaaccagcctgggatcaggtgaccctgagcgtctcaaactcagcactgttgacatttgggggtggctgattctttggggtggggccatcatgtgcactgcagtgtatggcagcatccctgtcctccccccaccagatgctggcagcacacgccacccgttcctcctgttgtgacaaccaaaaatgtctccggacattgccaggtgcccccagggggtgggggtggggttgggagtgggggccagaattcccccatttgagactcaatgaaatatttcagctgggcgtagtggccgatgcctgtaatcccaacacttcgggaggctgaggtgggagggtcacttgagcccaggaatacaagaccagcctggacagcatggtgtgaaacccatctctttaaaaaaaaaaaaaaaaattgaattagctgcacacgtggtgctgtgcacctgcagtcccagctactcaggaggctgaggtgggaggatcacttgagccttggaggtcgaggctgcagtgagccatgatcacaccactgcaccccagccagggcgacagaatgagatcctgtctcaaaaacaaacaaaaacaaacaaaaaaaaaaaaaacattgcgagggaagaaatacctcactttggccttgttgggggcagatgtgggaggatttggggtcacagtggttctcttggtgttggtccctgtttcagaagcctcccctccctctcactgactctgtttctttccatcattcttggtctttgtctctctctctcttttttttttttctttgaaatggagtctcactctgttgcccaggctaaagtgcagtggcgagacctcagctcactgcagcctccacctcccaggttcaaccgattcttcagcttcaacctcccaagtagctgggattacaggtgcacatgccaccacacccagctaatttttgtatttttagtagagacagtgtttcaccatgttgaccaggctggtctcaaactcctgacctcaagtgatctgtccacctcggcctcccaaagtgctgggattacaggcgtgatccaccgtgcccggccagtctttgtctctttgtatctctctctctccatctctctctgtttctctcttcctcttccccatctctccacttgatctctctctcactggacctccttgtgtgagtgagcatcacctctccattccccagtctctttctgtctctgtctcatttcctttccccatcttctctctatccctctctccatctgggcctctgtgtacatgtctttgggtctgtctgtccgtctgtctgtctgtatccttctcactcactcattcattccctcggtctctgcccccattctctcttggtccccggggtccccacagatgctgaatctctttgtcgccgtcatcatggacaactttgagtacctcacccgagactcctccatcctgggcccccaccacctggatgagtacgtgcgtgtctgggccgagtatgaccccgcagcttggtaagaagtcaccccgaatcctccagccacaatactcacctctccctggaactggaacacgggctaggtcaggccccagactctggagcactgaactcctggggtcctagcaggggtctcacaggttcagtcaggagagaagatataagaatcatcacccttgcataccccagattaaacacgtagggtgccaaccctgcccaaaccctggactttctgggaaatgagggagggcgtcaaccatgagatgtcctgaagagccctctcctcctacgagtctctcctgtctctcactgtgaagtctccagatggtgaggatgcattagccaggctccagggagaaaaccaacagcatcccagcctcagttctcttgagagtgtggggaggagggctggcctacccttggcagacaggattggcagcaacatcagagtagcagaactcagctcccactgggacccgtgaacctgggagtgagaggacatacaggccaggggaggacgcagagcctcaggggcccatgcatctttgtggccacaaagggagtgggcgctcccatctgggtagacaccagaggggtccctctccactgacgggcaatggtttcagagggtgggttccaccttgtgcacgtgtattgagtgcccacccaacaccaagccttgaaggacactcagaggctttatctgaatacctggaacccaccagccactaactgaggatttagttcaggctggtcttggggcctgaagaagcattactggggggccctcagcagcctaagccccatcttcctctggcctcagcaccagagaggaggccgtcacgaggaaggtgggcaggaggtggtcttggctattcccatagcctcaaacaagtactccatgagaccgagaggctggggagagccgtgggtctggggctgggctttggctggttcctaactcttcctcttttgattttaggtcacagcaattggatgctgtccccaaggcctctattccacaagcccccccccacccctgtagcccatgtagactgtggaggaggcagatgcagagagagccccaggggaggtgccctgcagtcccgaactcgactgacatcctacacccctgggtctccccagtgtctgggaatgtactggggaccttcacttgtccccagtctctcccactccttcaagccagggacaccccagcctcgggcatcatgacctcgctgtgtgcccagggagcccgtgtgaacccattgcctgcactaaccccctttcttctcctttcagcggtcggattcattataaggatatgtacagtttattacgagtaatatctccccctctcggcttaggcaagaaatgtcctcatagggttgcttgcaaggtttgacttccactaaaacctgctagcatccatggaatgagtgtggcttggggttcttcaatatatatatttcatatatatatatatatatatctctctctctctctaaaaaaacagagccatctctctttcttgcattaaactagaaaactctcttagccaacagaatgcagtcatgtagactcgataaagcatggaacatatttcctccttcccttcagccttcagccatctttgcttgctcttagctgaagctgcccatcctggggtctccacggcaccccaaatcagatacatcccctgggggattgtaactttgcatttctcccccaaccatcacctccactctctccccctccacccctcacctcccaaagcccctagccctcctcccctccctggcactggcccctgctccccacctaggccccctcagagaccagcctcagccaaaccagagaacgtgacccaactgtagaaataacagtgatggccgggcgcagtggctcatgcctgtaatcccagcactttgggaggccaaagcaggaggatcgcttgagcccaggagtttgagaccagcctgggcaacatagcaagaacccccttctctataaaaaattagccaggcattgtggcgcatgcctgtagtcccagctacttgggaggctgaggcagaaggattgcttgagcccaggaggtggaggctgcagtgagctatgatcacaccactgcactccaacccaggcgacagagagagaccctgtctctttaaaaaaaaaaaaaaaaaaaaaaaaaggcaatgaacaaaagcatggctctacgtcttccaaagtgagaattctccctcccctccgcatccctccagaactgtagctcagagcccacgctgaatctgacttttctcttttctctctctctccctgctcccgagcagtgaagtaatctttttttactgaccttttcttccattttttttcctcctcttttccattgatttgaaatatctattttatcattctctgcatctttctctctctattttttcggctcgtgtggatttcttttttctttcttctgtttctccccacctctcttcctttggttctctgttcccattcccgttttgtttttttgtttttgtttttgtttttttcattttcggtgctgccaggggccgcatgccttacctggacatgtatcagatgctgagacacatgtctccgcccctgggtctggggaagaagtgtccggccagagtggcttacaaggtagactacccttgccgaccaccgacgtccaggcactgggtttttttttcttcttcttcttctttttttttagtgctgaccagaaacacccggccgactctctttttccaacgtttctcttcttttttgtttttgattcttttttttcttttctcgagtcaactgatcatgaccatcccttgattctaagcagcacactgtgtccgtcctttctgatgagtgtcttcgtgttttgagactccattatggccgacatgccggggggagggggaggggagcgcccaggtccccttgcacctggtctcccaggtaccaaattggaaacaaacacgcttcttcagggagtcaaaacccatgcttcccacttctgcccacccagagcggcccccatgcccaggctggggcaggcgccttgcagagaggggctttagcccccgaaagcaggcgaggtcccgggtccccgcccctgccacgcacacctgaagctgatctctgacctagggccttggggattcgagaccttccaaggagcaccaagaacctctcttcccctcccttccttcccctggagtttcgtccccagcccccgtccctaatccccccaagacaccccaacatgcctctccattgttccagagtgggcaggcggccgcagctggacccctggacggtggcacactgatgcaggccatgcacgctgccttggcggggcctggggcgggcaggcaccatggccgacggggggtggtgcatgctggctgagagagcgagcgtcctgccgccaagcggctggcccgggccacccctccagatccctgtcctggaatctcccttggtgcccaaggacagatgctctgttccctccattcatccacaagaagttcagggatgacctttaaagattctccccacccaaaaagtattaccccatcatcctattctcccatccaccttgatcttccctgcgtccctatccatcaatgctatttgtacctgccccgtgttgccacctcattcctttccttcctctgtgcacccctcctcacctaacctatatgtctcccctccttctcaatcaaagccggggacaaggttgtcccaccagcatctcagacaatgagcctctcctggcacctgtcgctctgtgcccctccctgccgcccccccccccccccccggttttcctcaagtcgcttctctcagtctctgcttagatgaatgtgtgcgcatgtgcaagagagggagggcgagcccttcctctcctggtctttgtgcaggaccaccatgggtccataagacaactttgtgcaaatttgaaaaaggcaccctttccacagaacatgcctgttggaaaattgttgcaatctaccaatgtggtgagaacaagacactttttttctatcacctgggaagctgttatatttaatatacaaatcgggggctgggcgtggtggctcatgcctgtaatcctagtgctttgggaggctgagacgggaggatcacttgagcccagttcgagactagcctgggcaacatagcgagaccccatctctacaaaaagaaaaaatattttaattaataaataagtacataaatctatcatttccaagatgggagccctttgtgcggtgtacaacctgcacaactgtgcacagtggcccagtctatgtgtgtttctctatttcccacctccttccccaccctacccccagtgtcccctccagtgtcctgctctggatttaccatacccctccccatcttcaactctgtgtttcctgcccacttgtgtctgaatccccacccaagttgccctcaccccccttctctgtgccacttcagcctgggctggtgcacaccagcccagcatcctctcccatgccaccaagcatggtggacagagcccctgcctgggacatggggaatcttttcttccctgggctggaagggagtgcccctcaccccttccccctgccattgcacagagagccaagatctggacatgcccctgagatacacttcccacggagctatgaatgagtctcgagattccgtctgcatgcgcccctgtctgtgctgttctgtgtcacagcctcgctgcatgcctgcgaggggcctgccccgtcagtggggggctgcctgcctgctgcttctcagaggaatgatgtggtctgtgcccatctgctctgtcctggtctgggccaagccagggattgggtgtggggagccagtggcaccccccaccagcggctgtggtcctggccccctcagccttggctgttgcatgcactgctcaaatccagcttgtgctctttttctttggggtcagactgaaacggggccatccagaagaactctggggcagggcgggggtggggcaagggttgaggcaaaccctggaaatgccagctctcaggtcaagcaggtgggggaaaaaaggagagggcaggggaccagaagtacaagagagccttttgtgccctccctgcgggccaccaagagaaactgagtactgggacaggtaacctaagtaagagacacctcagccgccacagctttcagagttcttcctgggactccctgggtaggggcgggcgcggctcacgggagacccaggagggatgcctgggaatgactgcgcttgccttgggttttctgtagcggcttctgcggatggacctgcccgtcgcagatgacaacaccgtccacttcaattccaccctcatggctctgatccgcacagccctggacatcaagattgccaagggtaaggaagggacaggggcgggcacagacaggcgtgacagggtggaaccggggatctccctccctaccccaaactagaggatctgctgtcaccacccggatcttcattcactcttccattcattcgttccacagggttttttggggtttggggttttggtgtttttttttttttttttttgagacagagtcttgctctgttgcccaggcagcagtgcggtgacatgatcgcaagtcactgcagccttgacctcccaggctcaagtgatccttccacctcagcctccccagtagctgggactacaggcacacaccaccatactcggctaatttttttttttttggtgtgacaatttccctctgtcacccaggctgaagtgcagtggtgtgatcttggctcattgctacctccgcctcccgggttcaagcgattctcctgcctcagcctcccaagtagctgggattataggtacccaccagcacacccggctaattttttatattttgggtagagatggggtttcaccatgttggccaggctggtctcgaactcctgacctctggtctcaaactcctgacctcaagtgatccacctgcctcgacctctcaaagtgctggattacaggcgtgagccaccatgcccaacctaattttttatattttttatagagatggggtttcatcaggttgcccaggctggtctcaaactcctgggctcaagcagtcctcccaccttggtctcccaaaatgctggtattacaggcatgagccaccacacccggcccatttggcagatatttagtgcactccttcaatgtgccagagacccgtccaagcaggggaggacccagcagcttacactttagatggatggggaggccgccactgaggaggtaaggcagtgtctcatggatccctggggggaaggtgctccaggcagaaggactggcaaaggccctgacagaggggtgaacacaggacacccggggcattgagctgactcaccttctgagtgagggcacgccacgcaggttcagagcagaggaggaacctgacccaactcacatttgaacaggttccctccggccactgaggggatgggagaccgaaaggaggccagtgtgggggctgctgatatcatctgggtggagacagggcggcagcttagatctaggggtaggctcgacgtggtggctcacgcctgtaatctcagcactttgggaggccaaggtgggtggattacttgaggtcaggatgaccagcctggccaatgtggtgaaacccccgtctctactaaaaatacaaaatttagccagacgtggtggtgggtactgtagtcccagctactagggaggatgaggcagaagaatcgcttgaacctgggaggcggaggttgcagtgagccgagatcacgccactgcactacagcctgggtgacagagcaagactctgtctcaaaaattaaattaaattaaattaactggacatggtggcatatgcctgtggtcccagctactcaggaggcagagatgagagtattgcttgaagccaggagtttgaggctgcagtgagtcatgatcgcaccactgcactccagcctgggcgacagaacgagatcctagctcaaaacaacagaaagaaaaagaaaaaaacattttttttaaagctgagaaggggctgggcgcagtggcttacgcctgtaatcccagcactttgggaggccaaggtgggtggatcacgaggtcaggagttcaagaccagcctggccaacatggtgaaaccccatctctaccaaaaatacaaaaagtagccgggtgtcatggtgggcgcctgtaaccccagctactccggaggctgaggcaggagaatcacttgaacctgggagacagaggttgcagtgagccaagatcgcgccactgaactccagcctggatgacagagcaagacgctgtctcaaaaaaaaaaaaagctgaggccgggcacgctggctcacgcctgtaatagcagcactttgggaggccgaggcgggcagatcatgaggtcaagaaatcgagaccatcctgggtaacacggtgaaaccccttctctactaaaaatacaaaaaattagctgggtgtggtggcacgcacctgtagtccctgctactcagaaggctgaggcaggagaattgcttgaacccgagaggcagaggttgcagcgagccgagcttgtgccactgcactccagcctgggtgacagagtgagacttcatctgaaaaaaaaaaaaaaaaaaagccgagaaggctggacatggtggctcacacctgtaatctcagcattttgttgaggccaggcacagtggttcacgcctgtaatctgagcacgctgggaggccgaggtgggtggatcatttgaggtcaggagttcgagatcagcctggccaacgtggcaaaaccctgtctctactaaaaatacaaaaattagccgggtgtcgtggcgtgtgcctgtaatcccagcactttgggaggctgaagcgggtggatcacttgaggtcaggagttcaagaccagcctggtcaacatggcaaaaccctgtctctactaaaaatacaaaaattagccaggtgtggtggcgggtacctgtaatcccagttactagggaggctgaggcagaagaatcacttgaacccgggaggcagagattgcagtgagccgagatcacatcactgcactttagcctgggcgacagagcaagactccatctcaaaaataaaaataaaaataaaaaataccgagaaattcccccaaagacctagctcagggctcactctccatcattagggggaaagaagaagaggaggccagggaggcgggcagagaccagggcagtgtgggctcctggaggcagcttctatgtttaaaagggcggcttcaggaggaaggggaccaaccgtgtcaggcactgcccagagaccaaggatgacaaggatcacaagtgactggtcatcatggtcactttgaccagtgcagctttggcggaggggtcaggggtcccctgtctggagtgcatttcggaggcccgaaaggggatgtgatgtgatttggcagctgattaaggacagcagggcagagagacaggcgcacaattgccagaagaaacggggacctgaggctcacgcctgtaatcccagcactttgggaggctgaggaaggtggatcacttgaggccaggaatttgagaccagcctggccaacatggcgaaaccccatctccactaaaaatacaaaaattagccaggcatggtggtgcacacctataatcccaacaacttgggaagctgagcacaagaattacttgaacctgggaggcagaggttgcagtgagccgagatcaaaccattgcactccagcctgggggacacagcaagactctgtctcaaaaaaaaaaaaaaaaagaaagaaagaaagaaaagaaaaaacaaatgggaccagaaaaaaggagtgggtgggagaggagcaggtggatagtcccacacatgggaaggtgctgagcccagctgaaaccactagtaagtcaggaggagggaagactgagcctcgagacatatgtgccttccagggtcttgagggaaagaagggaggaagagccaaggccacgtggcaagactcaaggaggaagtggcagggaaggtgggggactggaggggtggaggacagatattgttaatgccaggaacaaagtgaaggtaaagagagcacaaggaagttgggagcagtggctcacacctgtaatcccagcactttgggaagccaaggcaggaggatcacttgaggccaggagttcaagatcagcctggccaacacagagagaccccatctctacagaaaattttaaaattagccaggtgtggtgatgtgcacctgtagtcccaactacttgggaggctggagtgggaggatcactggggactgggatgtcaaggctgcagtgagctatatgatgaccacagacatagcagcttaagacacacctatttgtcagctcacagtcctgtaggtcagaagtccaaaaagctggactgggctgtctgctgagggtctcacgaggctgaaatcaaggtgtcagccaagctgggctcctctctggaggatctgggggagaatctacttccaggttcattcaggtgttggcagaattgaagtccttgtggctgtaggactgaggtcttgttttatcactggctttttagctttttgctcctggaagtgcatgtaatcctccatgtgctctcattctctctgacttccccatctgccacccagcagagacaatactgtgcttttcaagggctcacctgattggggcaggcctaccctgatcatctctgtattttgaggtcagctgacttgatattttttttttttcttgagacagaatttcactcttgttgccaaggctggagtataatagtgtgatctcagttcactgcaatctccgcctcccaggttcaagcaattctcctgcctcagcctcctgagtagctgagattacaggtgcccaccaccacgcccagctaaatttttttgtatttttagtagagatggggtttcacaaggttggccaggctggttttgaactcctgacctcaggtgatccacccgcctcagcctcccaaagtgctgggattacaggagtgagccaccatgcccagcattttctttctttttttttttttttttgaaacggagtcttgttctgtcacccaggctggagtgcagtggcgcaatctcggctcactgcaacctccatctcccgggttcaagtgattctgcctcagcctcccaagtaggtgggactacagatgcgtgccaccacgcccggataattttttgtatttttagtagaaacggggtttcaccatgatagcaggatggtctcgatctcccaacctcgtgatctgcccacctcggcctcccaaagtgctgggattacaggcgtgagccaccgcaccgggcctccggtattttaattatatctgcaaagtcccttcatagcctgggcaatggtccctagattagtgtttgaataaacagaatcttggcagaagggcagcttttgaattctgcctaccacagttccttcgtttgtacaacgggtctaacaacacccccactctttgtatgtaatgccatcgtaactcagcttctgtggcactctgagaatctgtgttcaggggtcccaaaaccacccacaggttcagtgattccctggaagaactcagaactgagaaaagtttttatactcacagtttattacagtgaaagaatatagattaaaatctgcaaagggccgggcacggtggctcacgcctgtaatcccagcactttgggagggcgaggtaggcagatcacttgaggtcacgagttcaagaccagcctgaccaacatggtgaaaccctgtctctactaaaaatacaaaaattagccaggcgtggtggctggcgccagtaatcccagctacttggaaggctaaggtaggagaatcacttgagcccaggaggcagaggttgcagtgagccgagatcccgccacttcactccaggctggacagagtgagactctattagaaaaaaaaaaaaaaaaaaaatctgcaaagggcctggcatggtggcttacgcctgtaatcctggcactttgggagggcaaggcgggcagatcacttgaggtcacaagtttgagaccagcctggccaacatggcgaaaccccgtctctaccaaaaatacaaaaattaggcatggtgccagacccctgtaatcccaactactcaggaggctgaggcaggagaatcgcttgaccctgggaggcagaggttgcagtgagctgagactgtgccattgcactccagcctgtgtgacaagatcaaaactctgtccaaaaagaaaattagccaggtgtggtggcatacacctgtagtcccagctactccagaggctgaggcacaagaatcctttcaacccaggagatagagctacattaagccaagatcacgccactgcactccagcctgggcaacagagcaagactctgtctcaaacaaacaaacaaattccaaaaacataaaatgcgcaaaggaagggcatctggggaagggtccaggagacaccaggtgcgagcttccagttgtctgcctccagtggagttgcacagacaacgcttaattctccctgcagtgtgtgacaacacgcaccgtgtactgccaaccagggaagctcacctgagccttggtgccccagggtttttattgagggtttgtcatataggcagggctgacgtagttactcagtctccagtccctccagaggtcaaactgataccacgtggcccaagaccccaacgataaatcgcattgttagaatgaactgtatggaaaattatccaggcgtggcggcgggcggctgtaatcccagctactggggaagctgaggcaggagaatcacttgaaactaggaggccgaggttgcagtgagccaagatcgcaccattgcactccagcctgggcaatagagcaaaaacaccatctcaaaataaataaataaatagaatgaactgtattggccgggtacagtgactcatgcctataatcccagcactttgggaggctgaggctggaggatcgtttgaggccaggagttcgagaccagcctaggcaacatagtgagaccctatctcttttttttaaaaaaaaaaaaaaaaaaaaaaaagaatgaactatacagtgtggcccaaggccccctgctaaataaagacactcttcaggcaggacatttcaaaggcttagagatcacctcccaggagcaagtcaatgggccagtcctttcatcggaatgtgcagggtttggacaacactagcctactgagctagtccttactgcttagcaccccagcttctatgacacctactggattcccttcctgagggtttcaaagactcctggagatgtctctgaatttggctgtcacagttgttacttgtaccccagatgccactcagttccctgaagacaatgatcccccagatttctcagccaggagcccctccacctcttgtcctcagtgggtgccaggcctcatcctggagttccacagctgagccaggctctcggggttacggaaggtcaagagggtgtggggacaacaatggaagagtgataacagtggcagccctttgagcagatgcgggtctcaggagaacataacgcgctttcttttcatagttcagctcactttctaagcacactgagcttcctttccagcaggctaaggggctgcaaagggggtacagattaacctcattcttcagattctcaaaaatggtgtcaccattcattgctggagactgggagaaagggggcaagtccatctcattctctctgtctctgtctctctctctctcttccctgtccatctgtttctctctcccacccacccctctgttctctctgcccagaagaatctctattttggttttggttttgtttgttttgtattgttttgagacggagtctcgttctgtcgcccaggctggagtgcagtggcgcagtctcaactcaccactgcagcctccacctcccaggttcaagcgattctcatgcctcagcctcccgagtagttgggattacaggcgcacgccaccacgcccagctaatttttgcatttttactagagactggtttcaccatgttgaccaggctggaccctatcctctttcaagccccccaccccaggcattgagggcagagccaactacctgcctgaaccaattagcatattaaacgtaaacccagttagcatatccaaatagcagcccacagtgacattctgactgtcagaatgtggattgcttgagcccaggagctcaaggcttcggtgaacaaagattgtgccacagcctgggcaacagagtaagtccctgtcgatcgatagatagatgatagatagatagatagatagatagatagatagatagatagatagatagataaatttttaaaaaaaataataggccaggcacagtggctcatgcctgtaatcccagcactttgggaggccgaggcaggcagatcacctgaggtcaggagttcgagaccagcctggccaacatggtgaaaccctgtctctacaaaaatataaaaatagccaggcagatgtctgtaatcccagctactcaggaggctgaggtaggagaatcgcttgaactctgaaggtggaggttgcagtgagccgagatcatgccattgcactccagcctgagtgacagagcgagactccatctcaaaaataataacaataataaaaataataataaatgctctggccccaaagtggcacattacatggtgcacaccccattagcaaggactcatcacatggccctgccaaccacaggaggaacccccccatgtactcaggtaggagggccaggaaacaccgtcagagagctttaatgactcaccccatgactggggtgagggacgagggactggctgcaggccaagggcatgtccgtggcagtggagacttgggaaaggggaaaagacctcctctgagccacgcacagtggctttcatctgtaattccagcactttgggaggctgaggtgggaggatcttgagcccaggaggtcgagactgcagtgagctatgtttgtgccacggcactctagcctgggcgacagagcaaaaccctgtctcaaaaatcaaaataaaaccaaaaccaaaacttcctctgttggggatgctccagggcgtcccagccttgaacagatgggtcactgcagtaataatcctatggcagacactgtcccaaggctgcacgcacgttactttgatcatcaaacaaccaggtgatagccaggcatggtggtgcgtgcctgtagtcccagctactcaggaagctgaagcgggagaatctcttgaacctgggaggcggaggtaacagtgagtcgagatcacatgactgcacttcagcctgggaacagagagagactctgtcaaaaaaaaaaaaaaaacaggccagacgcggtggctcacgcatgtaatcgccagcactttgggaggctgaggagggtggatcacctgaggtcaggagtttgagaccagcctggccaacatggtgaaaccccgtctctactaaaaatacaaaattagttgggcgtggtggtgcacacctgtaatcccagctactcgggaggctgaggcaggagaatcgcttgaacccaggaggcagaggttgcagtgagctgagattgcaccattgcactccagcctgggcaacaagagtgaaactccatctcaaaaaaaaaacaaaaaaaaaacaaccagccaggcgcggtggcttacgcctgtaatcccagcactttgggaggccgaggcgtgtggatcacccgaggttaggagttcgagaccagcttgaccaacatggtgaaactccgtctctactaaaaatacaaaaaattagccaggcatggtggtgcatgtctgtaatcccagctactcgggaagctgagacaggagaattgcttgaacccaggagtcggaggttgcagtgagccaagctcgtgccactgcactccagcctgggcaacagagcaagactctgtctaaaaaaaaaaaaaaaacacacacacacacacacaacaaccaggtgaggcaagtactcttgctatcatctccatttcacagatggagaaactgagttactaagtggtagagtaacctaagtcatgcagccgataactgggagacaagattgggacccaggtcgcccagctgttctccatgccgggctgtctcctgcacagctgctccatggtcctggccccaccgaaaaccagagcccacaaggtcattccagcagcactgcccagggcctcctctgggccaggccgttggggaactggagaccccatggggaccagaaagattggggtctcgttctcgggagcctatggctttgcagctgacccagagtccagctgacacccaggcaggcagtcagggtctgtctacacccccattgcaggaggagccgacaaacagcagatggacgctgagctgcggaaggagatgatggcgatttggcccaatctgtcccagaagacgctagacctgctggtcacacctcacaagtgtaagagctgagcccagccctgggatccaatccaccaggacagatggagggggagggaaaggggaggcctggggagagtgttggcctgggctggtatacacagggacccaggacaagggccccaaagaggcctgcccttggtgagctcaccgtgtgtgtgcccccagccacggacctcaccgtggggaagatctacgcagccatgatgatcatggagtactaccggcagagcaaggccaagaagctgcaggccatgcgcgaggagcaggtgcgctgttcgccgctctggggacatctgggctggggacagtggcttgcatgtcaccacgggaaccaactggaatatgagggtggctgagccccagggcaggtccctgaaaagtaggggctgtgcacagcagctcacacctgcaatctcagtgctttgagaggccagggcagagggatcgtttgagaccaggatgagaccaccctgggcaacacagtgagactccatctctacaaaataaaacattagccaggcatggtggtgcacacctgtagtcccagctatttaggaggccaagatgggaggatcacttgaggccaggagtgggagaccagtctgggcaacatagaaagacccatatctctacaaaaaaaaaataaaattagctgcatgtggcgccatgcacctgtggtcccagctacttgggaggctgaggcaggagaatcacttgaacctgggaggtggaggttgcagcaagccaagatcaagccactgcactccagcccgggtgataagagcaggactctatctcaaaaaaaaaaaaaaaaaaaaaaaaaaaagttcttgccaaggacacatcatgtggattcattcttcattcagctgctccaccaacacttattgagtattactgtgtgcagggcgctgttctcagtcctcggggatgcacccatggggaaaataggccagaatccctgccctcagggagcagacattccaagtggggaaatgccaatggtagcaaatgactgaatcgtgcaacatccagcaaagagaaagaaagtgtcgtgggggaaagtggagaagaatccagaagataggagtatccaggggaggaggggatgcggtgggaaatgggtagttggggagcctccctgagaaagtgacatgtgagcaaaggcttgaaggaaaaggggagagggagtgagctaagcaatacctggaagggtgttccaggcagaggaaacagccagtgcaaaggctctgaggctggaccgtgcctgggttgtttgggtaacagcaaagaggccagtgtggtggaaaagagcagggaggagacaagggcaaggaggtgacagggcagatccttcagggccatgggagctgcaggaaggactctggctttttccccaagcaagtgggagccatggagggttctaagcaaaggagggataggacctgactcaagtgctcatgggcgccctctggtggctcttgtggaacagtggggttgaaggtaggagcgggagacctgggagaaggtgcctgcagtgagagatgaggacgtgggaccaggctggggctatgacttgggtggaggagtgagaagtggtccagttctgcgtggaattggaagggtctagatggatgagacctgagagagtgtgtgtgtgtgtgtgtgtgtatactggggatgtcgcaatgccttctgggtaccaccgtcccaccaccccacccttgtccacacactgctctctgccccattccccaggaccggacacccctcatgttccagcgcatggagcccccgtccccaacgcaggaagggggacctggccagaacgccctcccctccacccagctggacccaggaggagccctgtgagtgtcacccctgccagggaggtggagtgtgggggtgccgtggtccccacgttctggaagctgcccaagcgcccactgctaccccggcctctgtcccccatgcaggatggctcacgaaagcggcctcaaggagagcccgtcctgggtgacccagcgtgcccaggagatgttccagaagacgggcacatggagtccggaacaaggcccccctaccgacatgcccaacagccagcctaactctcaggtgcctctgtcccccaactccccaatggctcccagggcccgggtggttcaggtggaagggatctgggccccccacacacacacacctgcagctccctccctctgcagacaccagggatctggaggtcaggccccagagctcatctggctttgccatctgctccgcagtccgtggagatgcgagagatgggcagagatggctactccgacagcgagcactacctccccatggaaggccagggccgggctgcctccatgccccgcctccctgcagagaaccaggtgagggctttcaccactgccctggggctggacccctcactctgcactgggtagggccaggcccccccacaagcagcccagtgcatcccctccctgccggactcaggcctgggtagggactccttcagtctctgaagcagtctgcaggccccacccaccacctggtcacacctggagcacctgcagaccctcctccctcacagaggacagagaggaaagtgctccccctggggcagagggcagtggccactgcaaaatggtctctggctgccctggttggaggctgcagacaggggaggttgtggaagatttgtgggtgcagcagggttcaacagggccagctgagacctgccacgaagatcacccctacacaaacacacacacacatgctcaacatacatgcacacacatgtgcagctgtgcgcctactcagatgcttgcatacacacacgtgtgtgcacgtgggcatatacacactgcacatgtactcacacatgcacacatgtacgtgcacacgtgtctgcatatgggaacttggcaggtcctaggatacagtagcagagtctggggtgggtctgggggcagctgggctcgtattttctgtctggtctctgtgggagtcattggggggcacaggggtgtgtgcttgatgtgtgtctgtgtgtggccgcttcacccagctgccaggcccacctgcaggtgatcccgttgccttggactcatgggacagagggcccagaggcatagctggctgcccacccggcctgaacagcgggggcccatgcacgcagcccgcctctggaggagaacagggcatggctgtgagagcctggcccgggtgcgtggcatgtgtggctgtggcgagctttccgtgtgccgtgtgtggcgtctgcacggggcaggaggctgtgctgtgcctggctggaccagggtcacctgagggcctggcctctggctgctgggaacgtgggttggggagcacccagcgtgcatgctgctgctccctcaggaccgagctgctgggccccaggagagggttgggacaagcccagctgacggccaccacatggaagctttgagcatcggccggagccaggggttggggtgtgcatcgcatgaggcagagcccagggccaggggctcgaggctgcgccgtcctgtctttcggtcccatgcctctgccatttgtctgtctgcatctcctgtctgtctcctctgtacccatgggaatagaggacgcccagccccgggggcctgggacacccacccgccaggactttaacttttcttttcctccctgccttctccctccgatttctcttgatgccagtgccactcccctccttggcttcttctccatgcaccacctcctcactctccctcttgccttttatatttattttcttctttctgttttttctgtgtgcaccatcccatggggctgtgacagaggagaaggggccggccacgtgggaataacctcagtgtatgtaccgcgcctgcccagcgcccagcagggctccggccccctcttcctccccaccccccctccagggagtcccgtcatctctcaccgtccccggaccccaccctttctttggcaatcgcaccctctcccctccatggagcccaatccttgtgtgtggtgtcctgtgtgtgcccctcacccataagccctggtgggcggggccatccccatcctcacccctacccccttttcttcagggccccccacgccggaggacactggctctccaagagcctggcccactctgcacctctttctggggggcttcttctcctgacaccaccaccaacccctggtcctgcagctcctacctggagcagggccaccagcgctcagctgggctggaccctgggaggcgggcgtctgccccatctccctccttccctcctctgcctgctgcagagaaacctgtgtgtcagggcttgacccagggatgaagcaccagggaaaagagtgggcccccagagcctccagtgcctgggtatcccccacccccacccagagctccctagcttgggcctcaccagaaggactcagacttgtgggggcagcgagcacagccccgttagccgggaggacccaaagctgccatgccgggcacctggtcctgagcccataggtcagccagccacagtcggaggcttctcaccctcccaggagagcaagctggggcagggatgagtgcggcagtccagggctcccaggtttgcaccctggatgtggagagggcttccctctggccagcctgagcctgcccaactgtggctgggcccccaggactggagagtgaggatcagatctttctggtcagaacccaggatgggctcaaaaggagcagtcctgtctctgagggacagaggaatcctcaggctccaccctcagaggcctggccacacccagagccctgattgatcagggggagccaaggccccatggcatcccctggcccctgccccaggatggtcacaccgcagtcaccgaaggccaccaccaggctgccacaatggggcaggaaggaccgggaccacttggtgctagctgctgaccccagcccaccggcctgtcccctcccccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggtgggcagccctgtggtgctcagggacaagcagaacagaggagaggagaggggaggagaaggcagggcggaggagacactaaggaagaagaaagggagaggcctccatggagaggggacagagggggccaggcagcagctgcaggaacctgggtactaccccctccccccaacccactgacctgcctcggttcaggggatctctagggcccccacaccttccaggtggcctcctgtgtgtgcatctgccccacctctccctcacgaccacctgtgtgtctgtctgaccctcacccggcccaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcaggtgggtgcggctgcaagtgaccccaggctgggctcggccgggaggcggggaggagagaaggggataccccatccaacagccactctaggcaaaggtccccggatcccggctgtgaccacctcccatcctgcccccaagccaccggggtgcccggcggccggagcggacacggatccccaccacaccagctgcctatgctgtccccccagcccccttgcccacccgccgccccctccccgccgcccgcagctgcttgctcctcggttgtggatcatatttgagttctgggccgtgccgcccgacctttcactttcctttaacccggcttctgtttttgtttcaattatgatttctgtcctctggacgcctgtgagtaatttttgaaacttctgctatttttaaccccgaaacttacaaaactccatttctcatttctcttttcactttgttgtgttggttttcgactcctcccctccctgtctcactccccctcctcccctccctcctccctgtggctgttgcttttttccattcaatgtcctgtgtcccccctctcctcctcctcctcctcctccccctccccctcctccctctcctcccggcccctctcccttcgctcccctctcttcctcccaatcccgtgtctcctttgattttgttgtatctttttttttgatttcctttgtttcaattttcgtgtagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaa

SEQ ID NO: 2 - protein, 2506 aa, Homo sapiens
  ref <308>: DATABASE ACCESSION NUMBER: NCBI / NP_001120694.1
  ref <309>: DATABASE ENTRY DATE: 2013-09-14
  ref <313>: RELEVANT RESIDUES IN SEQ ID NO: (1)..(2506)
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 3 - protein, 547 aa, Homo sapiens
  ref <308>: DATABASE ACCESSION NUMBER: NCBI / NP_001120694.1
  ref <309>: DATABASE ENTRY DATE: 2013-09-14
  ref <313>: RELEVANT RESIDUES IN SEQ ID NO: (1960)..(2506)
MIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 4 - DNA, 8628 bp, Homo sapiens
  ref <308>: DATABASE ACCESSION NUMBER: NCBI / NM_001127222
  ref <309>: DATABASE ENTRY DATE: 2013-09-14
  ref <313>: RELEVANT RESIDUES IN SEQ ID NO: (1)..(8628)
gatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatgctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaa

SEQ ID NO: 5 - DNA, 1010 bp, Homo sapiens
  ref <308>: DATABASE ACCESSION NUMBER: NCBI / NM_001127222.1
  ref <309>: DATABASE ENTRY DATE: 2013-09-14
  ref <313>: RELEVANT RESIDUES IN SEQ ID NO: (5101)..(6110)
tgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagcc

SEQ ID NO: 6 - DNA, 78 bp, Homo sapiens
tcacacctcacaagtccacggacctcaccgtggggaagatctacgcagccatgatgatcatggagtactaccggcaga

SEQ ID NO: 7 - DNA, 25 bp, Homo sapiens
acggacctcaccgtggggaagatct

SEQ ID NO: 8 - DNA, 25 bp, Homo sapiens
agatcttccccacggtgaggtccgt

SEQ ID NO: 9 - DNA, 1010 bp, Homo sapiens
ggctgcgtagatcttccccacggtgaggtccgtggacttgtgaggtgtgaccagcaggtctagcgtcttctgggacagattgggccaaatcgccatcatctccttccgcagctcagcgtccatctgctgtttgtcggctcctcccttggcaatcttgatgtccagggctgtgcggatcagagccatgagggtggaattgaagtggacggtgttgtcatctgcgacgggcaggtccatccgcagaagccgcttgtaagccactctggccggacacttcttccccagacccaggggcggagacatgtgtctcagcatctgatacatgtccaggtaaggcatgcggccccaagctgcggggtcatactcggcccagacacgcacgtactcatccaggtggtgggggcccaggatggaggagtctcgggtgaggtactcaaagttgtccatgatgacggcgacaaagagattcagcatcagaaacgagcagaggaagatgaaggaaacaaagtaaaaataagcaaattcattgccacactctcgagtcaggatgccagagttcttatcacacggtttcccgctgaggcaggaaagcatgatgttgtgccaagcttccccggtggcactccggaagagaagcatgagggcctggaagaaggtccggaagttattgtgctcagtgatttggaactcatcttcatcactgtcctcgtcctccacgtcgatgccaatgttaccaaacacctgcatcccaatgatggcatagatgaagaagagcatggcgatcagcagacagacataaggcagggccttgaaggactgcacaaaggtccagagaagaatgcggatggtgtaaccctgacggagaagtttgatgagccgggcagctcggaagaggcggagaaagctcaggttgatgaagttattcccaaactcagtcacgaggatatcggtgatgctgcccagaacagtcacaaagtcgaagatgttccaggcatcgcggaaataattca

SEQ ID NO: 10 - DNA, 78 bp, Homo sapiens
tctgccggtagtactccatgatcatcatggctgcgtagatcttccccacggtgaggtccgtggacttgtgaggtgtga

SEQ ID NO: 11 - DNA, 25 bp, Homo sapiens
agatcttccccacggtgaggtccgt

SEQ ID NO: 12 - DNA, 1644 bp, Homo sapiens
atgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaa

SEQ ID NO: 13 - DNA, 28 bp, Artificial Sequence
  Synthetic primer
atacccatggtggctgcgtagatcttcc

SEQ ID NO: 14 - DNA, 28 bp, Artificial Sequence
  Synthetic Primer
aatgaattcctcatggctctgatccgca

SEQ ID NO: 15 - DNA, 29 bp, Artificial Sequence
  Synthetic primer
aatgaattctccaggccctcatgcttctc

SEQ ID NO: 16 - DNA, 29 bp, Artificial Sequence
  Synthetic primer
aatgaattctgaattatttccgcgatgcc

SEQ ID NO: 17 - DNA, 28 bp, Artificial Sequence
  Synthetic primer
atacaagctttggctgcgtagatcttcc

SEQ ID NO: 18 - DNA, 28 bp, Artificial Sequence
  Synthetic primer
aatacgcgtctcatggctctgatccgca

SEQ ID NO: 19 - DNA, 29 bp, Artificial Sequence
  Synthetic primer
aatacgcgttccaggccctcatgcttctc

SEQ ID NO: 20 - DNA, 29 bp, Artificial Sequence
  Synthetic primer
aatacgcgttgaattatttccgcgatgcc

SEQ ID NO: 21 - DNA, 28 bp, Artificial Sequence
  Synthetic primer
cgtatctagagatatagtctatggatgg

SEQ ID NO: 22 - DNA, 29 bp, Artificial Sequence
  Synthetic primer
gtaggccggcctctatcttgtgccagatc

SEQ ID NO: 23 - DNA, 29 bp, Artificial Sequence
  Synthetic primer
ataggccggcctggctggtgctaaccaca

SEQ ID NO: 24 - DNA, 30 bp, Artificial Sequence
  Synthetic primer
cgctggccggccccaagataagaaacaatt

SEQ ID NO: 25 - DNA, 44 bp, Artificial Sequence
  Synthetic primer
cgtatctagagatatagtctatggatggatcatctggatagatt

SEQ ID NO: 26 - DNA, 44 bp, Artificial Sequence
  Synthetic primer
cgtatctagagatatagtctatggatggatcatcgcctaatgga

SEQ ID NO: 27 - DNA, 44 bp, Artificial Sequence
  Synthetic primer
cgtatctagagatatagtctatggatggatcatcttacgctgga

SEQ ID NO: 28 - DNA, 19 bp, Artificial Sequence
  Synthetic primer
ctggccaacatggtgaaac

SEQ ID NO: 29 - DNA, 18 bp, Artificial Sequence
  Synthetic primer
ccgggttcaagcgattct

SEQ ID NO: 30 - DNA, 19 bp, Artificial Sequence
  Synthetic primer
ccgggttcaagcgattctc

SEQ ID NO: 31 - DNA, 32 bp, Artificial Sequence
  Synthetic primer
ataaggatccagccaccatgcagaagacgcta

SEQ ID NO: 32 - DNA, 100 bp, Artificial Sequence
  Synthetic primer
gtatctagattacttgtcatcgtcatccttgtagtcgatgtcatgatctttataatcaccgtcatggtctttgtagtcgcaccaatcatcgtcagtctcg

SEQ ID NO: 33 - DNA, 41 bp, Artificial Sequence
  Synthetic primer
aattgctagcgatgttccagaagacgggcacatggagtccg

SEQ ID NO: 34 - DNA, 64 bp, Artificial Sequence
  Synthetic primer
aattatcgatctattagtgatggtgatggtgatggcaccaatcatcgtcactctcgctgtaggg

SEQ ID NO: 35 - DNA, 20 bp, Artificial Sequence
  Synthetic primer
tgacagtgccatagtttgga

SEQ ID NO: 36 - DNA, 24 bp, Artificial Sequence
  Synthetic primer
aagtgtaaatagtgcaaattcccc

SEQ ID NO: 37 - DNA, 20 bp, Artificial Sequence
  Synthetic primer
aagaccatcatggccaacat

SEQ ID NO: 38 - DNA, 19 bp, Artificial Sequence
  Synthetic primer
ttggctcaacacaacctcc

SEQ ID NO: 39 - DNA, 21 bp, Artificial Sequence
  Synthetic primer
tctagccctccttgcctggaa

SEQ ID NO: 40 - DNA, 21 bp, Artificial Sequence
  Synthetic primer
tggaggttgaatttggaaatt

SEQ ID NO: 41 - DNA, 22 bp, Artificial Sequence
  Synthetic primer
gtgtccttcatctccaagttcc

SEQ ID NO: 42 - DNA, 22 bp, Artificial Sequence
  Synthetic primer
gaagcctgaacaactcctgact

SEQ ID NO: 43 - DNA, 21 bp, Artificial Sequence
  Synthetic primer
atgccccaggcctcttgctgt

SEQ ID NO: 44 - DNA, 21 bp, Artificial Sequence
  Synthetic primer
gggtagctcacagcaggtaga

SEQ ID NO: 45 - DNA, 21 bp, Artificial Sequence
  Synthetic primer
tggcatcatatttaccctgct

SEQ ID NO: 46 - DNA, 22 bp, Artificial Sequence
  Synthetic primer
tttcttcttgtcatctgcatcg

SEQ ID NO: 47 - DNA, 21 bp, Artificial Sequence
  Synthetic primer
gattggactgagcagtcagga

SEQ ID NO: 48 - DNA, 21 bp, Artificial Sequence
  Synthetic primer
tcttaacctgatacagtcatc

SEQ ID NO: 49 - DNA, 17 bp, Artificial Sequence
  Synthetic primer
acttccagctgctgccc

SEQ ID NO: 50 - DNA, 18 bp, Artificial Sequence
  Synthetic primer
atacagcaggtggcggag

SEQ ID NO: 51 - DNA, 20 bp, Artificial Sequence
  Synthetic primer
ctactgtgggaagctcaggc

SEQ ID NO: 52 - DNA, 20 bp, Artificial Sequence
  Synthetic primer
gggaaccaccttctctcctc

SEQ ID NO: 53 - DNA, 20 bp, Artificial Sequence
  Synthetic primer
cccaggaccagtgaagaaag

SEQ ID NO: 54 - DNA, 20 bp, Artificial Sequence
  Synthetic primer
aaagaggaaggggcaatgat

SEQ ID NO: 55 - DNA, 21 bp, Artificial Sequence
  Synthetic primer
gccggtagtactccatgatca

SEQ ID NO: 56 - DNA, 28 bp, Artificial Sequence
  Synthetic primer
atgatgatcatggagtactaccggcaga

SEQ ID NO: 57 - DNA, 21 bp, Artificial Sequence
  Synthetic primer
tgatcatggagtactaccggc

SEQ ID NO: 58 - DNA, 28 bp, Artificial Sequence
  Synthetic primer
tctgccggtagtactccatgatcatcat

SEQ ID NO: 59 - DNA, 21 bp, Artificial Sequence
  Synthetic primer
gccggtagtactccatgatca

SEQ ID NO: 60 - protein, 2266 aa, Homo sapiens
  ref <308>: DATABASE ACCESSION NUMBER: NCBI / NP_000059
  ref <309>: DATABASE ENTRY DATE: 2014-05-24
  ref <313>: RELEVANT RESIDUES IN SEQ ID NO: (1)..(2266)
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKVEADEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 61 - protein, 2512 aa, Homo sapiens
  ref <308>: DATABASE ACCESSION NUMBER: NCBI / NP_075461.2
  ref <309>: DATABASE ENTRY DATE: 2014-05-24
  ref <313>: RELEVANT RESIDUES IN SEQ ID NO: (1)..(2512)
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKVEADEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 62 - protein, 2261 aa, Homo sapiens
  ref <308>: DATABASE ACCESSION NUMBER: NCBI / NP_001120693.1
  ref <309>: DATABASE ENTRY DATE: 2014-05-25
  ref <313>: RELEVANT RESIDUES IN SEQ ID NO: (1)..(2261)
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAACGRIHYKDMYSLLRVISPPLGLGKKCPHRVACKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 63 - protein, 2263 aa, Homo sapiens
  ref <308>: DATABASE ACCESSION NUMBER: NCBI / NP_001167551.1
  ref <309>: DATABASE ENTRY DATE: 2014-05-05
  ref <313>: RELEVANT RESIDUES IN SEQ ID NO: (1)..(2263)
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 64 - DNA, 2717 bp, Homo sapiens
  ref <308>: DATABASE ACCESSION NUMBER: NCBI / NM_153480
  ref <309>: DATABASE ENTRY DATE: 2014-02-26
  ref <313>: RELEVANT RESIDUES IN SEQ ID NO: (1)..(2717)
cgagggctcctgctggtactgtgttcgctgctgcacagcaaggccctgccacccaccttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgggggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaactaagaaaaaaaaaaaaaaaaa

SEQ ID NO: 65 - protein, 667 aa, Homo sapiens
  ref <308>: DATABASE ACCESSION NUMBER: NCBI / NP_705613.1
  ref <309>: DATABASE ENTRY DATE: 2014-02-26
  ref <313>: RELEVANT RESIDUES IN SEQ ID NO: (1)..(667)
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLVWRSDVQFAWKHLLCPDVSYRHLGLLILALLALLTLLGVVLALTCRRPQSGPGPARPVLLLHAADSEAQRRLVGALAELLRAALGGGRDVIVDLWEGRHVARVGPLPWLWAARTRVAREQGTVLLLWSGADLRPVSGPDPRAAPLLALLHAAPRPLLLLAYFSRLCAKGDIPPPLRALPRYRLLRDLPRLLRALDARPFAEATSWGRLGARQRRQSRLELCSRLEREAARLADLG

SEQ ID NO: 66 - DNA, 2338 bp, Homo sapiens
  ref <308>: DATABASE ACCESSION NUMBER: NCBI / NM_033260.3
  ref <309>: DATABASE ENTRY DATE: 2014-05-10
  ref <313>: RELEVANT RESIDUES IN SEQ ID NO: (1)..(2338)
ctcaacgtcgaaccgaaggcgacacccacccaactcctccctctccgccccatagtccacccaacacttgcagcccctccagagaaaaagcccagcggaagaggactccggaaaagtgactatctcggaagaccagggtagagctcccgggagaaaaaggcgaagatccccggccccggatcgccatccccttccctggcaccagcttctctaggctgcgcgaaggaagagggtacgacgccggggagggactgggtgcgcgggcatgaagttggaggtgttcgtccctcgcgcggcccacggggacaagcagggcagtgacctggagggcgcgggcggcagcgacgcgccgtccccgctgtcggcggcgggagacgactccctgggctcagatggggactgcgcggccaacagcccggccgcgggcggcggcgccagagatacgcagggcgacggcgaacagagtgcgggaggcgggccgggcgcggaggaggcgatcccggcagcagctgctgcagcggtggtggcggagggcgcggaggccggggcggcggggccaggcgcgggcggcgcggggagcggcgagggtgcacgcagcaagccatatacgcggcggcccaagcccccctactcgtacatcgcgctcatcgccatggccatccgcgactcggcgggcgggcgcttgacgctggcggagatcaacgagtacctcatgggcaagttcccctttttccgcggcagctacacgggctggcgcaactccgtgcgccacaacctttcgctcaacgactgcttcgtcaaggtgctgcgcgacccctcgcggccctggggcaaggacaactactggatgctcaaccccaacagcgagtacaccttcgccgacggggtcttccgccgccgccgcaagcgcctcagccaccgcgcgccggtccccgcgcccgggctgcggcccgaggaggccccgggcctccccgccgccccgccgcccgcgcccgccgccccggcctcgccccgcatgcgctcgcccgcccgccaggaggagcgcgccagccccgcgggcaagttctccagctccttcgccatcgacagcatcctgcgcaagcccttccgcagccgccgcctcagggacacggcccccgggacgacgcttcagtggggcgccgcgccctgcccgccgctgcccgcgttccccgcgctcctccccgcggcgccctgcagggccctgctgccgctctgcgcgtacggcgcgggcgagccggcgcggctgggcgcgcgcgaggccgaggtgccaccgaccgcgccgcccctcctgcttgcacctctcccggcggcggcccccgccaagccactccgaggcccggcggccggcggcgcgcacctgtactgccccctgcggctgcccgcagccctgcaggcggcctcagtccgccgccctggcccgcacctgccgtacccggtggagacgctcctagcctgagtagcgccgcggggcccgggaacgccgagtgcgcgccgtcggggaggcgggaacgcgggcccgcgcgcggactttgcactttgaatccagaggaagatgaatttttaaaatctccatcaaacgtgccttaaagctaaagcattttgacaggagtatttaaacttagtccaggatattttcctttgtgttttataactttacagaggaccaaagcaattcttgttttagtttctttgcgaagcctgctcctccttcccttcataaggactttttttgtctttctttaacgcccaggcttcgtcttatttctactgtttttgtcgcaacttccattgatttatgtcccttccctcccccctaagtacatcagggaacctttccacactataaatgatatgactactgtttggggtttctgggcccccatccgtgtacgtatgtggcatttccaggtatgactgagtgtgagagacatgtcagaggctcttcagtgatttcttgctattgaccgatgcttcactgtgccaaaagagaaaaaaaatgttgggttttgtaattaaattatttatatatttttgaaacccgaattgaaaatgttgcaggcaacgggctacagctttattagtggttctctaactgtggtctccttgggccaagcaatttctttaaaggaaaagttgattatgtatgtggggtgccaggaccactgccttgaaagcaagtgtgatttttatttttaatattattttatttgtgtctgtgtacatattcatgtataaattttatgaaacccaagcatagtgcttattttttaataaaacaactgacttaacacattgtgaaaaaaaaaaaaaaaaaaaa

SEQ ID NO: 67 - protein, 403 aa, Homo sapiens
  ref <308>: DATABASE ACCESSION NUMBER: NCBI NP_150285.3
  ref <309>: DATABASE ENTRY DATE: 2014-05-10
  ref <313>: RELEVANT RESIDUES IN SEQ ID NO: (1)..(403)
MKLEVFVPRAAHGDKQGSDLEGAGGSDAPSPLSAAGDDSLGSDGDCAANSPAAGGGARDTQGDGEQSAGGGPGAEEAIPAAAAAAVVAEGAEAGAAGPGAGGAGSGEGARSKPYTRRPKPPYSYIALIAMAIRDSAGGRLTLAEINEYLMGKFPFFRGSYTGWRNSVRHNLSLNDCFVKVLRDPSRPWGKDNYWMLNPNSEYTFADGVFRRRRKRLSHRAPVPAPGLRPEEAPGLPAAPPPAPAAPASPRMRSPARQEERASPAGKFSSSFAIDSILRKPFRSRRLRDTAPGTTLQWGAAPCPPLPAFPALLPAAPCRALLPLCAYGAGEPARLGAREAEVPPTAPPLLLAPLPAAAPAKPLRGPAAGGAHLYCPLRLPAALQAASVRRPGPHLPYPVETLLA

SEQ ID NO: 68 - DNA, 2974 bp, Homo sapiens
  ref <308>: DATABASE ACCESSION NUMBER: NCBI / NM_000909.5
  ref <309>: DATABASE ENTRY DATE: 2014-05-10
  ref <313>: RELEVANT RESIDUES IN SEQ ID NO: (1)..(2974)
gtctgtgtcgaataatgtgtggcttctgttggattgcttttctttccaaaattcctaggcaatgcttccccgaggtgtgcacctttgtgaggtgtttgtggggttgggggagcttcaggcgctactcgcgggacgccgtcacgtgatccgggatgaggtggagttcggctttaaggaggcgtctcttcctagcttcatcaatctttaggatctgagcaggagaaataccagcggatcttccccactctgctcccttccattcccacccttccttctttaataagcaggagcgaaaaagacaaattccaaagaggattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgatcataatcatcttgaaacaaaaggagatgagaaatgttaccaacatcctgattgtgaacctttccttctcagacttgcttgttgccatcatgtgtctcccctttacatttgtctacacattaatggaccactgggtctttggtgaggcgatgtgtaagttgaatccttttgtgcaatgtgtttcaatcactgtgtccattttctctctggttctcattgctgtggaacgacatcagctgataatcaaccctcgagggtggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttatgcatataatataaagacttttatactgtacttattggaatgaaatttctttaaagtattactattaactgacttcagaagtacctgccatccaatacggtcattagattgggtcatcttgattagattagattagattagattgtcaacagattgggccatccttactttatgataggcatcattttagtgtgttacaatagtaacagtatgcaaaagcagcattcaggagccgaaagatagtctgaagtcattcagaagtggtttgaggtttctgttttttggtggtttttgtttgttttttttttttttcaccttaagggaggatttaatttgctcccaactgattgtcacttaaatgaaaatttaaaaatgaataaaaagacatacttctcagctgcaaatattatggagaattggggcacccacaggaatgaagagagaaagcagctccctaacttcaaaaccattttggtacctgacaacaagagcattttagagtaattaatttaataaagtaaattagtattgctgcaaatagttaaattatatttatttgaattgatggtcaagagattttccattttttttacagactgttcagtgtttgtcaagctttctggcataaatatgtactcaaaaggcatttccgcttacaatttgtagaaacacaaaatgcgttttccatacagcagtgcctatatagtgactgatttttaactttcaatgtccatctttcaaaggaagtaacaccaaggtacaatgttaaaggaatattcactttacctagcagggaaaaatacacaaaaactgcagatacttcatatagcccattttaacttgtataaactgtgtgacttgtggcgtcttataaataatgcactgtaaagattactgaatagttgtgtcatgttaatgtgcctaatttcatgtatcttgtaatcatgattgagcctcagaatcatttggagaaactatattttaaagaacaagacatacttcaatgtattatacagataaagtattacatgtgtttgattttaaaagggcggacattttattaaaatcaatattgtttttgctttttcaaaaaaaaaaaaaaaa

SEQ ID NO: 69 - protein, 384 aa, Homo sapiens
  ref <308>: DATABASE ACCESSION NUMBER: NCBI / NP_000900.1
  ref <309>: DATABASE ENTRY DATE: 2014-05-10
  ref <313>: RELEVANT RESIDUES IN SEQ ID NO: (1)..(384)
MNSTLFSQVENHSVHSNFSEKNAQLLAFENDDCHLPLAMIFTLALAYGAVIILGVSGNLALIIIILKQKEMRNVTNILIVNLSFSDLLVAIMCLPFTFVYTLMDHWVFGEAMCKLNPFVQCVSITVSIFSLVLIAVERHQLIINPRGWRPNNRHAYVGIAVIWVLAVASSLPFLIYQVMTDEPFQNVTLDAYKDKYVCFDQFPSDSHRLSYTTLLLVLQYFGPLCFIFICYFKIYIRLKRRNNMMDKMRDNKYRSSETKRINIMLLSIVVAFAVCWLPLTIFNTVFDWNHQIIATCNHNLLFLLCHLTAMISTCVNPIFYGFLNKNFQRDLQFFFNFCDFRSRDDDYETIAMSTMHTDVSKTSLKQASPVAFKKINNNDDNEKI

SEQ ID NO: 70 - DNA, 3947 bp, Homo sapiens
  ref <308>: DATABASE ACCESSION NUMBER: NCBI / NM_003654.5
  ref <309>: DATABASE ENTRY DATE: 2014-05-05
  ref <313>: RELEVANT RESIDUES IN SEQ ID NO: (1)..(3947)
gggggtggagccgggaccgcagcgcctgccgctcgctcggagctgtagccgccgctgccgccgctgctcttggctcggggacgcgggcgggcgctccgagaggctctggtgcctgcggctgctgctctcctccggcgcccggggctgcggcgctccgggtcccggcccctgtcccggcatctctcgggtccctgagccccggccccgggtcccgcgtccggccggagagaacgcactcagctgctcgagccgccccgggctcgcgcccccgggccatgaagaggggcccgtgaggcgcgcgcggagtcggaggaagaggagggaggagggaggccgaggaggagggcgcgggaggcggaggatgccgccgcggctgctgccgccgccgccacccgcgggtccccggcgaccctgactccagacccgaggatggagccggcgctgggcgctgcagctgctcccggcgcgtccccgaccaggtagctggtgtcacttcggtgtggttggaagaagactttctccccagctgcattcccggaggcgccctttcgacctggaggccgggtctgctggccacagggctgccgcactggctgggactgccagctgggcctggagacgctggtggctgtggactccccagcttggagcagtccctctttgacctcaccccttggagaagcagccccatgaaggtgcccagccatgcaatgttcctggaaggccgtcctcctccttgccctggcctccattgccatccagtacacggccatccgcaccttcaccgccaagtcctttcacacctgccccgggctggcagaggccgggctggccgagcgactgtgcgaggagagccccaccttcgcctacaacctctcccgcaagacccacatcctcatcctggccaccacgcgcagtggctcctccttcgtgggccagctcttcaaccagcacctggacgtcttctacctgtttgagcccctctaccacgtccagaacacgctcatcccccgcttcacccagggcaagagcccggccgaccggcgggtcatgctaggcgccagccgcgacctcctgcggagcctctacgactgcgacctctacttcctggagaactacatcaagccgccgccggtcaaccacaccaccgacaggatcttccgccgcggggccagccgggtcctctgctcccggcctgtgtgcgaccctccggggccagccgacctggtcctggaggagggggactgtgtgcgcaagtgcgggctactcaacctgaccgtggcggccgaggcgtgccgcgagcgcagccacgtggccatcaagacggtgcgcgtgcccgaggtgaacgacctgcgcgccctggtggaagacccgcgattaaacctcaaggtcatccagctggtccgagacccccgcggcattctggcttcgcgcagcgagaccttccgcgacacgtaccggctctggcggctctggtacggcaccgggaggaaaccctacaacctggacgtgacgcagctgaccacggtgtgcgaggacttctccaactccgtgtccaccggcctcatgcggcccccgtggctcaagggcaagtacatgttggtgcgctacgaggacctggctcggaaccctatgaagaagaccgaggagatctacgggttcctgggcatcccgctggacagccacgtggcccgctggatccagaacaacacgcggggcgaccccaccctgggcaagcacaaatacggcaccgtgcgaaactcggcggccacggccgagaagtggcgcttccgcctctcctacgacatcgtggcctttgcccagaacgcctgccagcaggtgctggcccagctgggctacaagatcgccgcctcggaggaggagctgaagaacccctcggtcagcctggtggaggagcgggacttccgccccttctcgtgacccgggcggtgcgggtgggggcgggaggcgcaaggtgtcggttttgataaaatggaccgtttttaactgttgccttattaacccctccctctcccacctcatcttcgtgtccttcctgcccccagctcaccccactcccttctgccccttttttgtctctgaaatttgcactacgtcttggacgggaatcactggggcagagggcgcctgaagtagggtcccgccccccccccccccattcagacacatggatgttgggtctctgtgcggacggtgacaatgtttacaagcaccacatttacacatccacacacgcacacgggcactcgcgaggcgacttctcaagcttttgaatgggtgagtggtcgggtatctagtttttgcactgtcttactattcaaggtaagaggatacaaacaagaggaccacttgtctctaatttatgaatggtgtccatcctttccccatccctgcctcctgcccctgacgcccatttccccccttagagcagcgaaactgccccctcctgcccgcccttgcctgtcggtgaggcaggtttttactgtgaggtgaacgtggacctgtttctgtttccagtctgtggtgatgctgtctgtctgtctgagtctcgtggccgcccctggaccagtgatgactgatgaatcttatgagcttctgattgatctcggggtccatctgtgatatttctttgtgccaaaaagaaaaaaaaagagtggatcagtttgctaaatgaacattgaaattgaaatgctttatctgtgttttctgtaaataaaagagtgcaataatctctgtgtgtgattgcaggacattctgaatgggtacgagagggcctcagccgggtctgggtgttcctagctttggggaggacagcgagagagaggtggaggtgggaattaaatgacaagtctgcctttcagaactcttgtcaccctcaacactgagtttagtttaggtttttgttttgttttgttttgagacagagtctcgctctgtcacccaggctggagtgcaatggcgccatctcggctcactgcaacctctgcctcccaggttcaagcagttctcccgcctcagcctcccgagtgactgggactacaggtgcacactgccacacctggctatttttttttttttttggattttagtagagacggggtttcaccgtgttgtccaggctggtcgcgaactcctgagctctgggcattcctcctgcctcagcctcccaaagtgctgggattgcagacttgagccacctcacccagccgttttttttttccttcagtcagttgagaccgggtaacttatagccagggataatgttcaaagtctttaacaagtggtatggcttgctgaatcagagtagctggaggtaagaatgacatcctggaatcccttcttgtgctaaatgttacccatttagttggtgggtctgggtctaggatagccagggagggggaaacttcaaggggtggggtgcctcagggcagtggctgctgacccacagacctggaagtatttgactatttgaataactggtacaggtttactggtgtctacactggcagagaatctgctgtgcttcctccccttcccttcgtggcaatctagcaggttgctccaggcagcttccccagctcttattccaagaaaacctgcccctggggtggctgcaggtcacagctttgttgtcctgggacaaaggagtgtctggtgattaggcagccccaggggtcctagccaactggaagaagggcttcctgaggaaacacagtcctgggctattttatatgtgtcaggaggatgtagacagttcaacagctctagcaaatgccttaactaatagtggcttaatcaagataggtgattttcttttgtaaaaaattttactggggtaaaataacagaatgtaaaatttaccatcttaacctttttaaggtgtaccattcattaaatacattcacaacgtgtgccaccaaaaaaaa

SEQ ID NO: 71 - protein, 411 aa, Homo sapiens
  ref <308>: DATABASE ACCESSION NUMBER: NCBI / NP_003645.1
  ref <309>: DATABASE ENTRY DATE: 2014-05-05
  ref <313>: RELEVANT RESIDUES IN SEQ ID NO: (1)..(411)
MQCSWKAVLLLALASIAIQYTAIRTFTAKSFHTCPGLAEAGLAERLCEESPTFAYNLSRKTHILILATTRSGSSFVGQLFNQHLDVFYLFEPLYHVQNTLIPRFTQGKSPADRRVMLGASRDLLRSLYDCDLYFLENYIKPPPVNHTTDRIFRRGASRVLCSRPVCDPPGPADLVLEEGDCVRKCGLLNLTVAAEACRERSHVAIKTVRVPEVNDLRALVEDPRLNLKVIQLVRDPRGILASRSETFRDTYRLWRLWYGTGRKPYNLDVTQLTTVCEDFSNSVSTGLMRPPWLKGKYMLVRYEDLARNPMKKTEEIYGFLGIPLDSHVARWIQNNTRGDPTLGKHKYGTVRNSAATAEKWRFRLSYDIVAFAQNACQQVLAQLGYKIAASEEELKNPSVSLVEERDFRPFS

SEQ ID NO: 72 - DNA, 941 bp, Homo sapiens
  ref <308>: DATABASE ACCESSION NUMBER: NCBI / NM_006744.3
  ref <309>: DATABASE ENTRY DATE: 2014-05-11
  ref <313>: RELEVANT RESIDUES IN SEQ ID NO: (1)..(941)
cgcctccctcgctccacgcgcgcccggactcggcggccaggcttgcgcgcggttcccctcccggtgggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgtcctgtgaaaaaaaaaaaaa

SEQ ID NO: 73 - protein, 201 aa, Homo sapiens
  ref <308>: DATABASE ACCESSION NUMBER: NCBI / NP_006735.2
  ref <309>: DATABASE ENTRY DATE: 2014-05-11
  ref <313>: RELEVANT RESIDUES IN SEQ ID NO: (1)..(201)
MKWVWALLLLAALGSGRAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCADSYSFVFSRDPNGLPPEAQKIVRQRQEELCLARQYRLIVHNGYCDGRSERNLL

SEQ ID NO: 74 - DNA, 1861 bp, Homo sapiens
  ref <308>: DATABASE ACCESSION NUMBER: NCBI / NM_000304.3
  ref <309>: DATABASE ENTRY DATE: 2014-05-26
  ref <313>: RELEVANT RESIDUES IN SEQ ID NO: (1)..(1861)
aataaactggaaagacgcctggtctggcttcagttacagggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccgggcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactcact

SEQ ID NO: 75 - protein, 160 aa, Homo sapiens
  ref <308>: DATABASE ACCESSION NUMBER: NCBI / NP_000295.1
  ref <309>: DATABASE ENTRY DATE: 2014-05-26
  ref <313>: RELEVANT RESIDUES IN SEQ ID NO: (1)..(160)
MLLLLLSIIVLHVAVLVLLFVSTIVSQWIVGNGHATDLWQNCSTSSSGNVHHCFSSSPNEWLQSVQATMILSIIFSILSLFLFFCQLFTLTKGGRFYITGIFQILAGLCVMSAAAIYTVRHPEWHLNSDYSYGFAYILAWVAFPLALLSGVIYVILRKRE

SEQ ID NO: 76 - DNA, 710 bp, Homo sapiens
  ref <308>: DATABASE ACCESSION NUMBER: NCBI / NM_002962.1
  ref <309>: DATABASE ENTRY DATE: 2014-02-08
  ref <313>: RELEVANT RESIDUES IN SEQ ID NO: (1)..(710)
tcccacacttctgaggttttctttccaggacagcctggtttcccttcttcggcttattgttccatcagatttcagattttgagttctgatttttggtcagaagagtaaagtttctgggattggggacgtgtgtgctatgggaactcagtgtgtccccagcccttgtttgtaaacaaggaagggacagagatcagggaaataaaggcagaaggcagtgagagggaggctatgcctgctgcttggattctctgggctcactcccacagtgagctgcacactgtgatggagactcctctggagaaggccctgaccactatggtgaccacgtttcacaaatattcggggagagagggtagcaaactgaccctgagtaggaaggaactcaaggagctgatcaagaaagagctgtgtcttggggagatgaaggagagcagcatcgatgacttgatgaagagcctggacaagaacagcgaccaggagatcgacttcaaggagtactcggtgttcctgaccatgctgtgcatggcctacaacgacttctttctagaggacaacaagtgaccagggctgccctccaccctcaccctccaccctttgctgctgacctcggctgctcctctcacagaccctctttggccccctgccctcctctccctcccagatggacccttccatgggaggaaataaagtttccatcgcaggtgctggga

SEQ ID NO: 77 - protein, 92 aa, Homo sapiens
  ref <308>: DATABASE ACCESSION NUMBER: NCBI / NP_002953.2
  ref <309>: DATABASE ENTRY DATE: 2014-02-08
  ref <313>: RELEVANT RESIDUES IN SEQ ID NO: (1)..(92)
METPLEKALTTMVTTFHKYSGREGSKLTLSRKELKELIKKELCLGEMKESSIDDLMKSLDKNSDQEIDFKEYSVFLTMLCMAYNDFFLEDNK

SEQ ID NO: 78-79 - skipped (2 entries)

SEQ ID NO: 80 - DNA, 922 bp, Homo sapiens
  ref <308>: DATABASE ACCESSION NUMBER: NCBI / NM_005855.2
  ref <309>: DATABASE ENTRY DATE: 2014-03-16
  ref <313>: RELEVANT RESIDUES IN SEQ ID NO: (1)..(922)
gcggccgccgcctcccaccgctcccgcgcccgctcccgcccccggcgcgtctcctccgggcccgcgccgcggcgggctcagtcctcagcggggcgcgtggcgagcggactcgactcggcaccgctgtgcaccatggcccgggccctgtgccgcctcccgcggcgcggcctctggctgctcctggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttgaacttggaaaaaaaaaaaaaaa

SEQ ID NO: 81 - protein, 148 aa, Homo sapiens
  ref <308>: DATABASE ACCESSION NUMBER: NCBI / NP_005846.1
  ref <309>: DATABASE ENTRY DATE: 2014-03-16
  ref <313>: RELEVANT RESIDUES IN SEQ ID NO: (1)..(148)
MARALCRLPRRGLWLLLAHHLFMTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 82 - DNA, 512 bp, Homo sapiens
  ref <308>: DATABASE ACCESSION NUMBER: NCBI / NM_002961.2
  ref <309>: DATABASE ENTRY DATE: 2014-05-04
  ref <313>: RELEVANT RESIDUES IN SEQ ID NO: (1)..(512)
attcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttt

SEQ ID NO: 83 - protein, 101 aa, Homo sapiens
  ref <308>: DATABASE ACCESSION NUMBER: NCBI / NP_002952.1
  ref <309>: DATABASE ENTRY DATE: 2014-05-04
  ref <313>: RELEVANT RESIDUES IN SEQ ID NO: (1)..(101)
MACPLEKALDVMVSTFHKYSGKEGDKFKLNKSELKELLTRELPSFLGKRTDEAAFQKLMSNLDSNRDNEVDFQEYCVFLSCIAMMCNEFFEGFPDKQPRKK

SEQ ID NO: 84 - DNA, 5954 bp, Homo sapiens
  ref <308>: DATABASE ACCESSION NUMBER: NCBI / NM_004822.2
  ref <309>: DATABASE ENTRY DATE: 2014-03-06
  ref <313>: RELEVANT RESIDUES IN SEQ ID NO: (1)..(5954)
cttcgggggcgagcgcgcgtgtgtgtgagtgcgcgccggccagcgcgccttctgcggcaggcggacagatcctcggcgcggcagggccggggcaagctggacgcagcatgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcgacgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagactgcgattcctactgcaaggcctccaaggggaagctgaagattaacatgaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctagcgccgaggcagcgggcgggcgggcgggcgggcgccagggcggggccgagcgagagcgggcgccttggcccggccgccgcggacttggcccgcgagggctttcccaggtggggggagggagggggcggggccgcacggcgcggggggcgggaccctcggcggcccctccccctacccccaccctgcgcgctctgggcgggagccgcgtgcacgcggggcggggtgcgccgccggccgggccctggagaaatgacgagacgtagctacctcacggggctccttccagagcagagacgcgcttccctgggcctgggcgcggccgccgtggaggggctgggggcagcctgccctggggcccgggggcgggcgcagaatcgcacaactggggccccaggcgcggggcgtggatggcgcggagacgtggacgggaggagaactgtgaattctcaagcccgtagtgtgggcggggcgcggagcacccaccaaaccaccacccgacacgcagccgacgggatccccccctttctccccggccccttctagcagttccccgcgggccacctggctgtcacagcctggactcctccatctgaaggggcctggcagcatttggggagtggacagctcctgtccagccagcatgccccaggcggcctctgtctccactgctacctgctgagtgggtcctactgggtgggggcttggggtcggtgagtggttcacctgtggagagaggagaggaagcccctgctgctgcctgtctctgcccctgcccctgcccctgcccagcgtggggctggcccatccggaaggcagtgggcccagggacacccctgagaagcccaagccgggtggtcaccgcctcatgctggagctgcctgttggaggaggcatcgcaaacgcaaaacctcccagagagtttccttttggaaacttggaaccagccctttttatgacgttttccagggggagggggaggggcactggctgggtttacggcagtgacactatttatgtaaatgacatcagctcccgcaaggcccctcagcaatgtcaacagctggaaagggcctgaacgggcttggagtctgcaggctgcgaaggcacttgggcctggcttggggccgggggcttgtttgagctgggatggggtttgctggctcagtgaagtaccagagtgcctgagccatgggtgggcaggggcacaggaatgaccaggttcctgggggccaaggaggccatgctggcttctccaagggaaggcacagaggctgccggcctgccccctacagctgtcttgggtctggcctgggccacaccttgaccgtgcctttccagacggtctttgtggagtctgcccgtgccctccactgtgccccagccctccttccaaaatctcctagagacacggtcctcaagcaggcagccccttttgttctgacctcctcacacagggtccattcctgtgccctggggcctcctggctccctgccttcctgggctctctgcactgcccgggcctctggcccacatcctcacacccggcgcactgaattaagaggcctggctcccctcacagtcaggaaattggtttcactttcccggccagagtttggctgctcaaaagggtcataccaagtatgaagctcggcccccggtggtctggcttccctccgccttccccacatttacccgcatcacggctgccatttattgagcacctgctgtgtgccaggcactttacccacatgctcccagtgtgtactcatgacaaccctgtgggacagggactcattatcaccagcaaggagactggagtacacgtgcccaaggtcatgctgcaaattggtggcaggactggggctcaaactccagagcccgactttctgaccaggggccacgctggccctcactgcactccagctctgcagcctacccgcccaatccctgtgcaggctgggagggtgctcttgggggagtggccaccgagcccctggccctggttactgcctcttgaggacactggcatctgggctggagaacaggagcccggggtggggtagggcatggggacaatcacatcttcagaggaggcagcaaagtggtgcgggatgcagggacggacttgccagatggcagctccaggttccaggaaggcaggccttggatgctccgaagaggtggtagaaaggtgtttttagaaaggtgttttggctgcctcagggtggttggagagactccaggagagactggcagaggtgcctcaggggcagggagcagacagacctgccctgggaaggggcatttggcttccctgaatccagcccaaggctagaagacagggcccctctccaagctgtcagcgcccctcggatgcccagtgtggtgtgctgggcgccatcagcatcacaaggcactacgctgctggggcggttgtcctatttctgtctatgccagtgtggtttcttcaccctgcccagaagggctgtggcagccccacgatatcccaccctgggtctgggtctcacgggtgtcctgtgaggggcttgcatttgtggtggtctctgaggccacctcagcaacggagctggcgacacgccaagcaacaaggcatcttgcggaaaattcagccagtgtcctgcccctcccttcggctcagcaccccgcagggcacaggctgtccgcccggtggtctggcccttggggaatgcgtcagggtgaccagatccaccatgctagcagccaggtcactgttgggattgcacggtcgtcacgagctgcctttcctatccacacacccagccaggacccagcccaccactcccgactgcagccccggcctctgcggtgagcaccatccttgggaaagcacccctcctccactccggtgccccactccaaggagcagagggaaatgggaattgaggtgtcccggtttgtacagttaggaagggatgtaaaacggaactagattttgattttgaagagtgtattaaccagaattgtgctatgtaggtgtttgtttgaagaaaaacataccagattagtctttgtttttgaaacagcttccccagttgtcctttttcttaccagctgggtggtctggtgcccctgacagctgagtgcctgctttacggacacgcagtaatgccgaagatttgcgggggaggacatagggctgtccccgggattcacctgctggctgtggtctctgcccactgcttctgtccttggaaagcagggcaggaggcagcatccccaggggcctctatgtgggagggagggacacctggggtcacaacccagggagggagggtcacagcccagggaggctgggagctgctccaaggccctggaactctgcctcagtcgcggcatgctggagaggggtacggacttactttcttggagttgtcccaggttggaatgagactgaactcaagaagagaccctaagggactggggaatggttcctgccttcaggaaagtgaaagacgcttaggctgtcaacacttaaaggaagtccccttgaagcccagagtggacagactagacccattgatggggccactggccatggtccgtggacaagacattcctgtgggccatggcacaccgggggggatcaaaatgtgtacttgtggggtctcgccccttgccaaaagccaaaccagtcccactcctgtcattggacgtttcttcccattccctcctcccaaatgcacttcccctcctccctctgccccctcctgtgttttggatttctgttcactcagaattgtaaatgtttagttgtgaccatgacgtattgtttgggtcaatgtccctttccaatgcatactaatatattatggttattatatatgaatatatttaatgacatggaaaaagttgtggattttctttctttccttttttttgggggggggtggggggttggttagagttgtaatggacccagatggaacttgtaatgtgggccccacatgatagaactaaattcagatatcattaaataaactcttgtacacta

SEQ ID NO: 85 - protein, 604 aa, Homo sapiens
  ref <308>: DATABASE ACCESSION NUMBER: NCBI / NP_004813.2
  ref <309>: DATABASE ENTRY DATE: 2014-04-06
  ref <313>: RELEVANT RESIDUES IN SEQ ID NO: (1)..(604)
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRDDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINMKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 86 - DNA, 1246 bp, Homo sapiens
  ref <308>: DATABASE ACCESSION NUMBER: NCBI / NM_007341.2
  ref <309>: DATABASE ENTRY DATE: 2014-02-26
  ref <313>: RELEVANT RESIDUES IN SEQ ID NO: (1)..(1246)
attttcctgacagatcccaaaatattcctgggccaatggagggaggagcccaagatgcctctgctgctccttggagagacagagcctcttaagttggagcgggactgccggagcccagtggacccctgggctgctgccagccccgacctggcacttgcttgcctgtgtcactgtcaggatttgtctagcggcgcattccctaacaggggtgtgttggggggagtcctctttccaactgtcgaaatggttatcaaagtgtttgttgctacatcttctgggtccatagcgattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaataaaaaaaaaaaaaaaaaaaa

SEQ ID NO: 87 - protein, 239 aa, Homo sapiens
  ref <308>: DATABASE ACCESSION NUMBER: NCBI / NP_031367.1
  ref <309>: DATABASE ENTRY DATE: 2014-02-26
  ref <313>: RELEVANT RESIDUES IN SEQ ID NO: (1)..(239)
MPLLLLGETEPLKLERDCRSPVDPWAAASPDLALACLCHCQDLSSGAFPNRGVLGGVLFPTVEMVIKVFVATSSGSIAIRKKQQEVVGFLEANKIDFKELDIAGDEDNRRWMRENVPGEKKPQNGIPLPPQIFNEEQYCGDFDSFFSAKEENIIYSFLGLAPPPDSKGSEKAEEGGETEAQKEGSEDVGNLPEAQEKNEEEGETATEETEEIAMEGAEGEAEEEEETAEGEEPGEDEDS

SEQ ID NO: 88 - DNA, 859 bp, Homo sapiens
  ref <308>: DATABASE ACCESSION NUMBER: NCBI / NM_002925.3
  ref <309>: DATABASE ENTRY DATE: 2014-02-26
  ref <313>: RELEVANT RESIDUES IN SEQ ID NO: (1)..(859)
ggcgtctctgggaaggcagtggattgttggtctgcgtggaacttctcaggtggacaccagagcatggaacacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaataataataacttggaagttttagtttacaaaacagagattccttcaacactggacacgtcgagcattttgtagcttaattaaacctcatgtaaggccaaaaaaa

SEQ ID NO: 89 - protein, 167 aa, Homo sapiens
  ref <308>: DATABASE ACCESSION NUMBER: NCBI / NP_002916.1
  ref <309>: DATABASE ENTRY DATE: 2014-02-26
  ref <313>: RELEVANT RESIDUES IN SEQ ID NO: (1)..(167)
MEHIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 90 - DNA, 1039 bp, Homo sapiens
  ref <308>: DATABASE ACCESSION NUMBER: NCBI / NM_145040.2
  ref <309>: DATABASE ENTRY DATE: 2014-02-01
  ref <313>: RELEVANT RESIDUES IN SEQ ID NO: (1)..(1039)
gttgcaggcagacggagcagagcggtcagggatcatgagggagagtgcgttggagcgggggcctgtgcccgaggcgccggcggggggtcccgtgcacgccgtgacggtggtgaccctgctggagaagctggcctccatgctggagactctgcgggagcggcagggaggcctggctcgaaggcagggaggcctggcagggtccgtgcgccgcatccagagcggcctgggcgctctgagtcgcagccacgacaccaccagcaacaccttggcgcagctgctggccaaggcggagcgcgtgagctcgcacgccaacgccgcccaagagcgcgcggtgcgccgcgcagcccaggtgcagcggctggaggccaaccacgggctgctggtggcgcgcgggaagctccacgttctgctcttcaaggaggagggtgaagtcccagccagcgctttccagaaggcaccagagcccttgggcccggcggaccagtccgagctgggcccagagcagctggaggccgaagttggagagagctcggacgaggagccggtggagtccagggcccagcggctgcggcgcaccggattgcagaaggtacagagcctccgaagggccctttcgggccggaaaggccctgcagcgccaccgcccaccccggtcaagccgcctcgccttgggcctggccggagcgctgaagcccagccggaagcccagcctgcgctggagcccacgctggagccagagcctccgcaggacaccgaggaagatcccgggagacctggggctgccgaagaagctctgctccaaatggagagtgtagcctgagggctggtgttgcctgcctcccctgtgcttgtgccttgtcccaaaataaatcctttcagaatgtagcactcacgccctaataaggagcgaatcctacatccaccaaggcgggcgctctggccctcccttccttaagcccagtcctgtgtcctctgaaagaggtgcagtcactcacacctgcttgcgctcaccatcaataaaagtaatttcacccgaaaa

SEQ ID NO: 91 - protein, 261 aa, Homo sapiens
  ref <308>: DATABASE ACCESSION NUMBER: NCBI / NP_659477.2
  ref <309>: DATABASE ENTRY DATE: 2014-02-01
  ref <313>: RELEVANT RESIDUES IN SEQ ID NO: (1)..(261)
MRESALERGPVPEAPAGGPVHAVTVVTLLEKLASMLETLRERQGGLARRQGGLAGSVRRIQSGLGALSRSHDTTSNTLAQLLAKAERVSSHANAAQERAVRRAAQVQRLEANHGLLVARGKLHVLLFKEEGEVPASAFQKAPEPLGPADQSELGPEQLEAEVGESSDEEPVESRAQRLRRTGLQKVQSLRRALSGRKGPAAPPPTPVKPPRLGPGRSAEAQPEAQPALEPTLEPEPPQDTEEDPGRPGAAEEALLQMESVA

SEQ ID NO: 92 - DNA, 782 bp, Homo sapiens
  ref <308>: DATABASE ACCESSION NUMBER: NCBI / NM_004378.2
  ref <309>: DATABASE ENTRY DATE: 2014-02-02
  ref <313>: RELEVANT RESIDUES IN SEQ ID NO: (1)..(782)
aaggcgcgcagcgctgggcgcaaagcgccagtctccgccttgcgagctcagagtgtgcccgctgcgccgccgctgtccgtacctgccgccgccgccaccgccaccatgcccaacttcgccggcacctggaagatgcgcagcagcgagaatttcgacgagctgctcaaggcactgggtgtgaacgccatgctgaggaaagtggccgtagcggctgcgtccaagccgcacgtggagatccgccaggacggggatcagttctacatcaagacatccaccacggtgcgcaccactgagatcaacttcaaggtcggagaaggctttgaggaggagaccgtggacggacgcaagtgcaggagtttagccacttgggagaatgagaacaagatccactgcacgcaaactcttcttgaaggggacggccccaaaacctactggacccgtgagctggccaacgatgaacttatcctgacgtttggcgccgatgacgtggtctgcaccagaatttatgtccgagagtgaaggcagctggcttgctcctactttcaggaagggatgcaggctcccctgaggaatatgtcatagttctgagctgccagtggaccgcccttttcccctaccaatattaggtgatcccgttttccccatgacaatgttgtagtgtcccccacccccaccccccaggccttggtgcctcttgtatccctagtgctccatagtttggcatttgcacggtttcgaagtcattaaactggttagacgtgtctcaacctttaaaaaaaaaa

SEQ ID NO: 93 - protein, 137 aa, Homo sapiens
  ref <308>: DATABASE ACCESSION NUMBER: NCBI / NP_004369.1
  ref <309>: DATABASE ENTRY DATE: 2014-02-02
  ref <313>: RELEVANT RESIDUES IN SEQ ID NO: (1)..(137)
MPNFAGTWKMRSSENFDELLKALGVNAMLRKVAVAAASKPHVEIRQDGDQFYIKTSTTVRTTEINFKVGEGFEEETVDGRKCRSLATWENENKIHCTQTLLEGDGPKTYWTRELANDELILTFGADDVVCTRIYVRE

SEQ ID NO: 94 - DNA, 1477 bp, Homo sapiens
  ref <308>: DATABASE ACCESSION NUMBER: NCBI / NM_005525.3
  ref <309>: DATABASE ENTRY DATE: 2014-05-04
  ref <313>: RELEVANT RESIDUES IN SEQ ID NO: (1)..(1477)
gggaaattggctagcactgcctgagactactccagcctcccccgtccctgatgtcacaattcagaggctgctgcctgcttaggaggttgtagaaagctctgtaggttctctctgtgtgtcctacaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggtttctttaaaaccataaactgtacaaatgaaatttttcaatatttgtttcttaaaaaaaaaaaaaaaaaa

SEQ ID NO: 95 - protein, 292 aa, Homo sapiens
  ref <308>: DATABASE ACCESSION NUMBER: NCBI / NP_005516.1
  ref <309>: DATABASE ENTRY DATE: 2014-05-04
  ref <313>: RELEVANT RESIDUES IN SEQ ID NO: (1)..(292)
MAFMKKYLLPILGLFMAYYYYSANEEFRPEMLQGKKVIVTGASKGIGREMAYHLAKMGAHVVVTARSKETLQKVVSHCLELGAASAHYIAGTMEDMTFAEQFVAQAGKLMGGLDMLILNHITNTSLNLFHDDIHHVRKSMEVNFLSYVVLTVAALPMLKQSNGSIVVVSSLAGKVAYPMVAAYSASKFALDGFFSSIRKEYSVSRVNVSITLCVLGLIDTETAMKAVSGIVHMQAAPKEECALEIIKGGALRQEEVYYDSSLWTTLLIRNPCRKILEFLYSTSYNMDRFINK

SEQ ID NO: 96 - DNA, 5734 bp, Homo sapiens
  ref <308>: DATABASE ACCESSION NUMBER: NCBI / NM_001201.2
  ref <309>: DATABASE ENTRY DATE: 2014-02-26
  ref <313>: RELEVANT RESIDUES IN SEQ ID NO: (1)..(5734)
agatcttgaaaacacccgggccacacacgccgcgacctacagctctttctcagcgttggagtggagacggcgcccgcagcgccctgcgcgggtgaggtccgcgcagctgctggggaagagcccacctgtcaggctgcgctgggtcagcgcagcaagtggggctggccgctatctcgctgcacccggccgcgtcccgggctccgtgcgccctcgccccagctggtttggagttcaaccctcggctccgccgccggctccttgcgccttcggagtgtcccgcagcgacgccgggagccgacgcgccgcgcgggtacctagccatggctggggcgagcaggctgctctttctgtggctgggctgcttctgcgtgagcctggcgcagggagagagaccgaagccacctttcccggagctccgcaaagctgtgccaggtgaccgcacggcaggtggtggcccggactccgagctgcagccgcaagacaaggtctctgaacacatgctgcggctctatgacaggtacagcacggtccaggcggcccggacaccgggctccctggagggaggctcgcagccctggcgccctcggctcctgcgcgaaggcaacacggttcgcagctttcgggcggcagcagcagaaactcttgaaagaaaaggactgtatatcttcaatctgacatcgctaaccaagtctgaaaacattttgtctgccacactgtatttctgtattggagagctaggaaacatcagcctgagttgtccagtgtctggaggatgctcccatcatgctcagaggaaacacattcagattgatctttctgcatggaccctcaaattcagcagaaaccaaagtcaactccttggccatctgtcagtggatatggccaaatctcatcgagatattatgtcctggctgtctaaagatatcactcaactcttgaggaaggccaaagaaaatgaagagttcctcataggatttaacattacgtccaagggacgccagctgccaaagaggaggttaccttttccagagccttatatcttggtatatgccaatgatgccgccatttctgagccagaaagtgtggtatcaagcttacagggacaccggaattttcccactggaactgttcccaaatgggatagccacatcagagctgccctttccattgagcggaggaagaagcgctctactggggtcttgctgcctctgcagaacaacgagcttcctggggcagaataccagtataaaaaggatgaggtgtgggaggagagaaagccttacaagacccttcaggctcaggcccctgaaaagagtaagaataaaaagaaacagagaaaggggcctcatcggaagagccagacgctccaatttgatgagcagaccctgaaaaaggcaaggagaaagcagtggattgaacctcggaattgcgccaggagatacctcaaggtagactttgcagatattggctggagtgaatggattatctcccccaagtcctttgatgcctattattgctctggagcatgccagttccccatgccaaagtctttgaagccatcaaatcatgctaccatccagagtatagtgagagctgtgggggtcgttcctgggattcctgagccttgctgtgtaccagaaaagatgtcctcactcagtattttattctttgatgaaaataagaatgtagtgcttaaagtataccctaacatgacagtagagtcttgcgcttgcagataacctggcaaagaactcatttgaatgcttaattcaatcattagtttatttttatggacttcttcctgttttttttttttttttttttgcactgccaatgcattttgtttcaaaagattatttctatagtcagaggggaatgagcaaatagactgaagattgccaccaaggaaaagaactgtatttgtttctgaatgtaacttaaagcaagatttttagtaaatatggacatctatttctctttttgtaatcaaacacaacaacttatcaaactgtttttagaactgttagagaacacactggtttatttttgtaatgttctttgaaaacagaatggagaagcagcaatagcttgtcatttatctcatttaatgactaatgggaaatagagaacaatttcgcgttttgaattaggcttattgccttagaatcctgagaaagtgctaaataatcaactctgatgtttttcttaagttcttgagactcttgtttatccttgtttttcctccacaagtcattgtctaagtgtaatggaaagtttatgctgagcgttagtgtgtatgtatgtgcgtacatgcgccaggtgcctgtgccctctgtaggatggtttgcttaatatggttttataattcagtttacacaggattctttattttttttaattttgtattttggcaaacaccattcagttataagaactttgccaaatatgatagaataattcaagagcatatacagagagttaccacttgacccagctatttaattgcaaatacagttgttttcatttcatttcctaccagaaaaaggaatcagaaacctagtttttgaaaacacaagtgtaattcctcttttgtacttctttttcacaaatgcttttatttattctaaattgaatttaaaaatccttcctaaagccattaactctttaattctcctgatatgcctttacttcctatgaagttattggtagatgttgaggcccaaaaactggtagaatattgaagatcttcttaaatgaccaatttaaccataaccaaatattgaatatcattcttcagtcacatctaagtcaggcactttttcacatagatcagggcttttggctcagtcacgaaatctacaagttagcaaagcttacaaaacattattcgtcaggtatgggaatcaaatatagacacttgtttgtctttgctttccatttctatgtgtcacatacatatatgtgtcctcttataactttagtcttcaaaattatttcaatatccttcttctcactatatttatttgtgtgatggaaatgctttcaggccgtagatcattgttggtgttaatctgtggttaatcctcattttagttccgtcttatctgatacttagaaatatctcagccattttggaggctgtgcagtatcagaagacgtggagtttgttctgtctctgcctgtagctaattatggtggttcagtcatttaataaatatgttttgagcatctattttgtgaaaggcactgtgttacctgtgtgtctttagtgtcctcactggtaaaatgaagaggctggccatgagctggaagggttaagtttataattccagctatttcacacccgtcttccttgaaggaatgatagtgatagatataaaaacactgtaagtccctcttttaataaactaaatgaaagaacatcctatacttcgctgtttgtaaattagtatggcattcgctttggtttaagtggtattttattgcaaacccattaaaagaataactcatgaaaagaagctctttgacaccttggggtacacaaatgttggtgtgggtgtgtgttaattctgtgagtgagacacaccagttctaaaaaaaatgagtgaagttctggtgcctgagttaccatgctttcttctagttcttacagtagcataaaattaaagattcaaagtgagatggaggataaaattactttttaatacatgttctcaaacatttgaaaataaaagtatatgatagaagggggccagagtgtggccaccatcctgatcgtactgtttttcaataaagaaaactttttcattggtagatttggtgaaattctaaatttaggtttttttctagagctgtatcaaccaaaacttctggcaattcccagtatcacttcttagccttcttatatccaaatgcctgtttattacctttcttaatttgaatcaatgcctagttattacagattgcaccccacaatggccaaaaacccactacataataaaatttacaggtactaactagttaagattatattttaagtagcaattgatataaaattacaacacaatgaaagaacttgggtaatctcttagcaatggaaataggttttaaccagcagtttttctgggtgctttgtaactatcattttactaatgaattgaggatgtattatggtttaaattggaagagttttattcccaaagaataaagcaagattatctttcagtagtagagattgaagtaaatgtattaatattttaattaatacagatttactaagagtagttagaaaatttagtaagtgcctgttttacaaattgttaggtactagtttctgtataattcctacacagaagctttagaaatctcctgatattaaattattaaattggcattcatgaaaagagaagctacaattataaactccatttgctaaatcatgcataatactctctctctctcttcccccacaagtaatctctctaccccatgcagtgtgcacacacacacacacacagtcagttactgaaaaaaataattctttttctttttttttttaaatggagtttcactcttgtcgcccaggctggagtgcagtggcgtgatctcggcccactgcaacctccacctcccaggttcaagcagttctcctgcctcagcctcctgagtagctgggattacaggtgtccgccaccatgcctggctaatttttttatttgataaaaagaattctttttctcaataactgttctcttgaattcaaattaagggactgccaaagtcaattagaatattttaaaaatactttgttgtaacctgtgtaaataatatacaatttacaggatttgggattgtagaacttaaactggaagactggattcctcagatctcaggactataacattccagataaatttttacattccctttgctgtatattaactgatgatcatttatatgttaagattttttaccttaatatttctgaataaaactcttattgcccatttaatattttcataggcaatcaaatgtgagtaatactgctaagagtctgatttattaaaaatatttgtataattcattcagtttagtttttcagtttagtctttctgctttcacttttctctgtgctaacaagtaactaatgtctgggcattgacttcttattgaatcaaagttgggttaggcatagctatgcacacctgatgtgtaagattaaagaagagattaaataagaaatcttgggtaagttggacttttctgtatagctcttttttcctctgagttgtattttaatgtagtttataagtgataaaatgatccttgttttctaaaagccagtccttcccttcagctttccacagtttctgtaaatgtttaatacttgtacagtcaatggcaattttaaatatatatatatatataatatatgtatatggaaaaggttcaaagatgcttttaatttatttaatgactattgccttcctataataataattttcatccttaattatgataatacttttagcaagaaaaattcctttttactacagtttttagatgcaaaatgcagtttggttctttagtcaaatccacttagagggtatattgcagtgaaactgtgaaggatacttcactaccaatgtataagctttgttgaatttgtatcattttctttcagtaatgaaaagctattcattatacagtatggaaataaaaattgcttcattga

SEQ ID NO: 97 - protein, 472 aa, Homo sapiens
  ref <308>: DATABASE ACCESSION NUMBER: NCBI / NP_001192.2
  ref <309>: DATABASE ENTRY DATE: 2014-02-26
  ref <313>: RELEVANT RESIDUES IN SEQ ID NO: (1)..(472)
MAGASRLLFLWLGCFCVSLAQGERPKPPFPELRKAVPGDRTAGGGPDSELQPQDKVSEHMLRLYDRYSTVQAARTPGSLEGGSQPWRPRLLREGNTVRSFRAAAAETLERKGLYIFNLTSLTKSENILSATLYFCIGELGNISLSCPVSGGCSHHAQRKHIQIDLSAWTLKFSRNQSQLLGHLSVDMAKSHRDIMSWLSKDITQLLRKAKENEEFLIGFNITSKGRQLPKRRLPFPEPYILVYANDAAISEPESVVSSLQGHRNFPTGTVPKWDSHIRAALSIERRKKRSTGVLLPLQNNELPGAEYQYKKDEVWEERKPYKTLQAQAPEKSKNKKKQRKGPHRKSQTLQFDEQTLKKARRKQWIEPRNCARRYLKVDFADIGWSEWIISPKSFDAYYCSGACQFPMPKSLKPSNHATIQSIVRAVGVVPGIPEPCCVPEKMSSLSILFFDENKNVVLKVYPNMTVESCACR

SEQ ID NO: 98 - DNA, 1784 bp, Homo sapiens
  ref <308>: DATABASE ACCESSION NUMBER: NCBI / NM_001099401.1
  ref <309>: DATABASE ENTRY DATE: 2014-05-24
  ref <313>: RELEVANT RESIDUES IN SEQ ID NO: (1)..(1784)
cgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcaatggagtttcgctcctgttgcccaggctggagtgcaatggagcgatcttggctcactgcagcctccgcctcccaggaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaaaaaaaaaaa

SEQ ID NO: 99 - protein, 462 aa, Homo sapiens
  ref <308>: DATABASE ACCESSION NUMBER: NCBI / NP_001092871.1
  ref <309>: DATABASE ENTRY DATE: 2014-05-24
  ref <313>: RELEVANT RESIDUES IN SEQ ID NO: (1)..(462)
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQWSFAPVAQAGVQWSDLGSLQPPPPRNLPHQTQIPQQQTTGKWYP

SEQ ID NO: 100 - DNA, 3150 bp, Homo sapiens
  ref <308>: DATABASE ACCESSION NUMBER: NCBI / NM_022138.2
  ref <309>: DATABASE ENTRY DATE: 2014-05-10
  ref <313>: RELEVANT RESIDUES IN SEQ ID NO: (1)..(3150)
gggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagtctccttgcaaatcttttccgttctgaattcagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaactata

SEQ ID NO: 101 - protein, 457 aa, Homo sapiens
  ref <308>: DATABASE ACCESSION NUMBER: NCBI / NP_071421.1
  ref <309>: DATABASE ENTRY DATE: 2014-05-10
  ref <313>: RELEVANT RESIDUES IN SEQ ID NO: (1)..(457)
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTVSLQIFSVLNSDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 102 - DNA, 9682 bp, Homo sapiens
  ref <308>: DATABASE ACCESSION NUMBER: NCBI / NM_005504.6
  ref <309>: DATABASE ENTRY DATE: 2014-05-10
  ref <313>: RELEVANT RESIDUES IN SEQ ID NO: (1)..(9682)
agtagggaggtgggcaggagccagtgatgacggaatggcaatcacatttgacctctgatctgtttatttcctcctccttgacgtctccatataaatgttacacgggcatccccacactcggatacgcacccacagtggctgattcgggggtaaccgtgtcatttgcttgcaacactggcacctctgccctgcaccccgggagtgagcagtgagtgaggctcgggtctgggcgctggctccgaatcttcgggctgggagagactccaccatctgggggcggcctgggggagcagccttagtgtcttcctgctgatgcaatccgctaggtcgcgagtctccgccgcgagagggccggtctgcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaacattaatgtaagccatataacatgggattttcctcaatgattttagtgcctccttttgtacttcactcagatactaaatagtagtttattctttaatataagttacattctgctcctcaaacaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacatatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcataggagcacaaatcctattgtgaactctgcatgcaagggatctaggctatgcgctccttatgagaatctaatgcttgatgacctgaggtgtaacagtttcatcctgaaaccacccttcaccctgcagtctgtggaaaaattgtcttccacaaaactggtccctggtgccaaaaatgttggggaccactgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttgtggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatgataaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactaaatttctattcctatgagaaatgagaattatttatttgccatcaacacattttatactttgcatctccaaatttattgtggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtttctacatttcagaccgagcttgtcagcttttttgaaaacacatcagtagaaaccaagattttaaaatgaagtgtcaagacaaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgctgtaagaaaaaatgtaagacaaaaaaaaaaaaaaaaaacaaacagaggcagaggcaggcagtagcaagaaagcagagcgtaacatcagctagatggtaacatgcaatgtcagctctcttgaagacatgggaaacctaagttacaccttgggttaaaattcttcaccatattagttttgttgcttcataaaatttacctaagcaagtggtcttgcttgcctcaaatccaagcagtcttgaacacttggaggcaattaatgagtatatcttagtcaaaagaattgttggagctttttattaaagctacagtttcagttctgcttttggggaattgtgctatgaaagcagctgccaaaataagctcatttattttcttcaatcccactcagtgctcagtcactatattctgtttcctttttttttttcaagttgcatatttggtttccccttatgattgggaaagatgaattttcagcagaaaacattgtttgttcactttcaaagagtgatagtttctaaaacatttagagcaataaatattcatcagaggtaccaagtaagccggcagaagagttaagggttagagaaatcccttatttcatgtcttgactctaaaattatcaaagtacttttccttgtaatgtggatttcttcttatgcggatatgcaaaaacttcagttatacgtagtaatgctagcaggtaattttagtagacattttataacaactgtcactttgtttcgccacatgtagagtttgttcagctattttccagatatctccccacaaaaggaggcaaagggtaccagcttttcaatgagcattacctattacttggcaaagatgatgaagactctattaatagttcatttgataaatgttgacataaccaacaatagagattaggaagttagttttaagaaatcaatggcatatagacattaccctcatggagtttgtattctactacttgaactgattgtagctataaaagcatagttagatagctgaatagttagatcataagcaaagaaggccagaacacatctcttatcaagaaatcaatgaatagtttatctcatttttaaagcaactttatccttctttaattccttcctttcttctagtgcaaaactacttaataaggttggtgtttaggttagtgttcacaccattcctcatctggtgtgaattaccttctctttctttactatttactaccaacctagtacatgtgttgactgaattcttttcaaacaatgttgagttatcatggtgcacctaataaattaacaccacagattacagcatccttgctgattttctcagcaaagccagattagatggaaataaacaaagaaaatgatcctagagtgaatttttctagaaaatatctattatgaaccatgctgtttaaagtattagcttgaaggtgatggatccagctattcagaaaataactttcatataaccatgattttgcacagtatgaggtcttaaatgtgtggaaagagataaattttttatcattaccacaaaccccttttaaagattcaaaggtggaagaaagtgatttattttttctcttcagcatacatatataaaagacttgtcagatgtttaatttggggaggttgataatgaaacatatcaacagagtatagtagttatagtagtgtttgtgggtaaataatttcctggggtcagacatatataaacatatttgcttcaaaatgataaaggcatgaaatcagtcttaaaaattgaaatgggggtgatgggggagaaaaagaagaacaaatttgaagtgccctttcaaatctgctggatacaagtattgaagttttaagtcatcttattctgtctgaaagtgtatttttcattctacaatagacccaatcaacaagacgtataacttgagttgcatgatgttcagtttatgtaatctactgttgggatggtaagaattgatgtaggctgtggtgtaagaatgaattaaaatatagtttcactggcttttctctacatatccactatcacaatggctaggtttcctgttgctcactattggattctggagaaaaatttaatgaaagatgatatcagaggaagaataagtggaggtagagaagaaaggaatgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgacttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtttgtgtggtttcatgaaatcagcattgttgaatgcatgaagtaataatgctaaattaacatttttatgatgtctcaaggtttctggtcaagggaagtaaatgtaggatagtatttttacaccaaaatgacacagagagaattgagcacaccagaaagaccagaaaccacaccactggatagagattcaatatgtttctttttcaaacatttggacaagaaaaaaatgggcatttaaaaattcttccttcccctggttatggatttatctgtagtaaaacttagctttgtcgtttgagatttgcacagaatggggggagtagattacctcttcccattcattgtcataatggatctacatcactgataaacaccatacttctatatgtggttaactagctttagaataaaagacactttaaaaagtaaaaggcctagagatcttcaatgaagtgtcccttttagccaaaccaggccttgcagaaattgtcctcaaaagcaccaagggagaacaaagccaagtgcagaattacccaagggtcacacattttgtattcattttcttataatttgcccaaatgatttgaagtacagcaaaacctgaagttttgcaaagagttactgtaaactgaacttaaaaatgtcagagtgctcggtgacccacttctccagaccctgtcaacctgtgaaaatattggcctttattcagatctctcaagaagttacgcgcagagtttggaaggtctaggcaaaggttattagtcaagtgttcttacagtgtcaacgctcaattcccacaagcgtgagaaagagagacctgtcattcctgagggtgatgacatacatttactggagcttatataatttatcagataagacagcagtttccttcagggtagaaagtgtgttttctacattgatttagtacaaaacaaaaagaaaaggggatatttcaaattttataattatttttctgctaagctgattcagtgtgatttaagcatatttttcaaatcatgaatctgattccatatacatatgtgccttatattgtgataatttatttttaagtgaaatatgctatcatagcctgactttatgtatagtggtgacaacttgcaggatcgcatttctgtaaccaaacggccgacagctgaggtgtagatgcttcctatggtctgtagaataatcactgggcttgttctctagctatgtctgtatgcaatcgcgacagtgttgatcaaaacccatgatcattctctccaaaggtctttgtcactaagccactagggattctgaaaagttcgtgagctgaaacaaataaattgagttggaagattaaaaaaaaaa

SEQ ID NO: 103 - protein, 386 aa, Homo sapiens
  ref <308>: DATABASE ACCESSION NUMBER: NCBI / NP_005495.2
  ref <309>: DATABASE ENTRY DATE: 2014-05-10
  ref <313>: RELEVANT RESIDUES IN SEQ ID NO: (1)..(386)
MKDCSNGCSAECTGEGGSKEVVGTFKAKDLIVTPATILKEKPDPNNLVFGTVFTDHMLTVEWSSEFGWEKPHIKPLQNLSLHPGSSALHYAVELFEGLKAFRGVDNKIRLFQPNLNMDRMYRSAVRATLPVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWGEFKVSERYLTMDDLTTALEGNRVREMFGSGTACVVCPVSDILYKGETIHIPTMENGPKLASRILSKLTDIQYGREESDWTIVLS

SEQ ID NO: 104 - DNA, 3646 bp, Homo sapiens
  ref <308>: DATABASE ACCESSION NUMBER: NCBI / NM_003383.3
  ref <309>: DATABASE ENTRY DATE: 2014-05-10
  ref <313>: RELEVANT RESIDUES IN SEQ ID NO: (1)..(3646)
ctctccggccgccgccggtgcgggtgctccgctaccggctcctctccgttctgtgctctcttctgctctcggctccccaccccctctcccttccctcctctccccttgcctcccctcctctgcagcgcctgcattattttctgcccgcaggctcggcttgcactgctgctgcagcccggggaggtggctgggtgggtggggaggagactgtgcaagttgtaggggagggggtgccctcttcttccccgctcccttcccccgccaactccttcccctccttctccccctttcccctccccgcccccaccttcttcctcctttcggaaggactggtaacttgtcgtgcggagcgaacggcggcggcggcggcggcggcggcaccatccaggcgggcaccatgggcacgtccgcgctctgggcgctctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgacggcagtgatgaaaagaactgtgtaaagaagacgtgtgctgaatctgacttcgtgtgcaacaatggccagtgtgttcccagccgatggaagtgtgatggagatcctgactgcgaagatggttcagatgaaagcccagaacagtgccatatgagaacatgccgcatacatgaaatcagctgtggcgcccattctactcagtgtatcccagtgtcctggagatgtgatggtgaaaatgattgtgacagtggagaagatgaagaaaactgtggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtccctctcgaacttgccgacctgaccaatttgaatgtgaggatggcagctgcatccatggcagcaggcagtgtaatggtatccgagactgtgtcgatggttccgatgaagtcaactgcaaaaatgtcaatcagtgcttgggccctggaaaattcaagtgcagaagtggagaatgcatagatatcagcaaagtatgtaaccaggagcaggactgcagggactggagtgatgagcccctgaaagagtgtcatataaacgaatgcttggtaaataatggtggatgttctcatatctgcaaagacctagttataggctacgagtgtgactgtgcagctgggtttgaactgatagataggaaaacctgtggagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctggctttgtttactggtcagactggggtgaaccagctaaaatagaaaaagcaggaatgaatggattcgatagacgtccactggtgacagcggatatccagtggcctaacggaattacacttgaccttataaaaagtcgcctctattggcttgattctaagttgcacatgttatccagcgtggacttgaatggccaagatcgtaggatagtactaaagtctctggagttcctagctcatcctcttgcactaacaatatttgaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtactgcaactactgtgacttacagtgagacaaaagatacgaacacaacagaaatttcagcaactagtggactagttcctggagggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatgaaaaaaaaaa

SEQ ID NO: 105 - protein, 873 aa, Homo sapiens
  ref <308>: DATABASE ACCESSION NUMBER: NCBI / NP_003374.3
  ref <309>: DATABASE ENTRY DATE: 2014-05-10
  ref <313>: RELEVANT RESIDUES IN SEQ ID NO: (1)..(873)
MGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQSTATTVTYSETKDTNTTEISATSGLVPGGINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 106 - DNA, 3868 bp, Homo sapiens
  ref <308>: DATABASE ACCESSION NUMBER: NCBI / NM_022912.2
  ref <309>: DATABASE ENTRY DATE: 2014-05-03
  ref <313>: RELEVANT RESIDUES IN SEQ ID NO: (1)..(3868)
aacgccgggcagggcggcgggcgcgctcagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttcttttaaaaaaaaaaaaaaaaa

SEQ ID NO: 107 - protein, 201 aa, Homo sapiens
  ref <308>: DATABASE ACCESSION NUMBER: NCBI / NP_075063.1
  ref <309>: DATABASE ENTRY DATE: 2014-05-03
  ref <313>: RELEVANT RESIDUES IN SEQ ID NO: (1)..(201)
MVSWIISRLVVLIFGTLYPAYYSYKAVKSKDIKEYVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSGTA

SEQ ID NO: 108 - DNA, 9145 bp, Homo sapiens
  ref <308>: DATABASE ACCESSION NUMBER: NCBI / NM_145793.3
  ref <309>: DATABASE ENTRY DATE: 2014-03-16
  ref <313>: RELEVANT RESIDUES IN SEQ ID NO: (1)..(9145)
gctctcatctcaaagcgcgccctcccttccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtgaaaaacctgatgcagtgctccatccaaactcagaaggctttgggatatgctgtattttaaagggacagtttgtaacttgggctgtaaagcaaactggggctgtgttttcgatgatgatgatgatcatgatgatgatcatcatgatcatgatgatgatcatcatgatcatgatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaacacctgtcacatccaaatatagtatctgtcttttcgtcaaaatagagagtggggaatgagtgtgccgattcaatacctcaatccctgaacgacactctcctaatcctaagccttacctgagtgagaagccctttacctaacaaaagtccaatatagctgaaatgtcgctctaatactctttacacatatgaggttatatgtagaaaaaaattttactactaaatgatttcaactattggctttctatattttgaaagtaatgatattgtctcatttttttactgatggtttaatacaaaatacacagagcttctttcccctcataagtagtgttcgctctgatatgaacttcacaaatacagctcatcaaaagcagactctgagaagcctcgtgctgtagcagaaagttctgcatcatgtgactgtggacaggcaggaggaaacagaacagacaagcattgtcttttgtcattgctcgaagtgcaagcgtgcatacctgtggagggaactggtggctgcttgtaaatgttctgcagcatctcttgacacacttgtcatgacacaatccagtaccttggttttcaggttatctgacaaaggcagctttgattgggacatggaggcatgggcaggttctcctttctttggaaacacatccatgctgggatgcacagttcttttcctaaggattgtgtttactcctgactgcaacgtcttggccactgtttggagcagtttggtctgaaggtcattaaggatctgcttgcatcttgtttcatgtcctccgtgacagactgcagaccatgttagaagagaaggaaggtttgtggatcaagagggttgacattaggtttggtgagatgagttgcttggcacagatcagcagaacaggaccctggtgataaggcatctggctttgctaaccacttatcatcttccattattctctttcttaactaagtagacccgaaagtgcacttttgaagtctggtttagatggcgagattccgaatctacaatgatcgagtactggtggccacttttctccaacattaagtaaagaggaggagattccaccttcagaaagtgctgggaagcattggctttcttcccacattggtagaagagatggaggaggaaaccagggtgcacatttctacagatcccctttgcctgctggtgtttgccttgtaagataagtcactggggggaaggggaaatctatgaaatccaagataaaggcatagtctttcagctctattggtgttaaaagtatatttgtgtccaaatgttaatcaacacaaatgtacagtactcagtactgacttttttcacttcaaaatgttttcaagggaaattcagcagacacccaactgtatttaattagtgaaaagatctataaagactcttactttgaataaacacattaagtaagtgtgtcaaaatatttggaatgccagttatctatgagcgcatatctcttacagagtgtattttgttttcattaaggtatctctgtgtatctacactggactaatttcatagggatctgattctatgtgatccactgtagaaagctactgattacttctgcagtaacagcagctctaattagcatcagatgaccaaagcggaaatgggagtttcagcgctaacaagggcagccttcattgaagaatgcatgggtaggcaatatataaattacattttgaaaagcctcatctgtcaccaacaaatatctcatttttcttcagtgataaaagcatattcaagttaccagctcctcaatttgaaaatcagttgctgattaaataaatagggggaagcatcttgttcagggacaacacgttagagagattcttatcaaagcaagccaagcaaggtttccgccattcagtgtgatcttagtttgacacggtgaccctaaaacaccatcatttgccccagaactggagcacaataagttaaatcatttacctgtctcacttcttcttggcgtgcttaaaagcaaaaatgattcgctacttcctgtccttcagtccgggcatttggggtgccactgaagacaggggttatctgctgaggtttgggtgtcttgcaggaagtatctcattgcagttgattttgatgaaaccaaacagtaactagggtccatgcagaccgtgactccctgattacatctagccatgccctacttatttcagagagaaagagagggggaataaaggcagtattgccacactgattagaagcacattcattccactttgatgttgaatatttttgaccgatacatgcttgagtatctttttaatagagcacatgaaggaagaagcacacaatatagagaaggaattgagaatgccaattacatatttatttttccatacctgatttttttcaagtctgtaataaaaaaagtataagttgagattaacataggttatttttcatgaagtatagcaaacgatctagaatgtgataggagtgtggtttccatttctttttttttttttttaacagacttttgtgctgtagtaagaatgtcttagaagttgtgtcttcgagttcctcaaacaccggacagggctcccccagagctgcctcagcctttgatttggtccatattcagacacttcctgtcttgcatacactctgaggatgggccgcttctagctgccgcccgtctccctcttgccttcttgtctctaaatcagacactcccaagcactccatctgctatactaggagagtgggagagccaaagcattttggagtccatgtaaagtgcctgggaaaagagatgtaagagcagtgggagtttatataattagcgaattcttttctcagaattcagcggaaatgtatttctgttgttattatttacaaaattgtggcctcagaggagctgtcttttggaaaataagttttcattcatgcagttagttagacatgcacgatgtacttgaatcaataaactgtggaccagaaaagggctgcttaaatgaattcacgtgttctaattctctttcgaggctgttgatgacctcctggattcatacccccatgatctgtcttgctcttgcctctgttctttgataaagcacatcagactatgtgacacccatcttttcaagaacgacctaaaagcaatgacaacaggcaggagagaattaccactggcctgggcacagtgacagcagaaggcccacctgagcttggagagttggcgagataaggcaaaatcaaggtgcaacagtgggccatgttccaagggtgaatggatctgagagtccgctgatgttccttactgatcagaacagggaccttctaacgaaacagccagagttccttgaatcaggcagaagttctttagagacaggaagccagagctattgataatatccgaacgacagaggaaggaatttcttattagaaattctaaaataaaacaagtggggatttggttggatacccttagaagctacatttttctctcatccctaagatagatatctcaagtgtatatctgacacctcttggctttgacacggctctgcttctcaagtgaccatttgttttaagtctgttgtctagaattctttgtgggggctggacctctgaaaaagattctcactgcagaggctttaaatctgtgtttttttccactccctccgtcctgggatgtattcggtaggacatttcatttatatcaggatattggctgattcagctctctttcatcgttattattcaggcctccctccaccaccttgttctttattgcctaagtattgccctccccaattcttcatcgtaatagctctaaatttagtttgacccaaattaatttttgttccaacagatatattttaagacagagaagcctctctcaggagccagatgatctgaagatgatgctaatccccaaatacgaagttcctccagctaactctcctctgagctccctcttcttagctttgggattggggatggtctcatccttgccaggaatccctttgttgctcccagtgtctctgatgagcttctcctccctcccagagacaatgcaggggtggttttcagcagaatgtgccacctgcacttctgattgttctgagacccagcccagaggggtggagaaggcgcacaaaccctattccaataaactgcctgcagagaaccacagcctgctaatagtcgttgaggtctcagccccctaaggtctccaagctcatttgaccagcgcagctgcgacttcggctgtctgcctctggcaggtgccaatatcagcatcttgtcccactgccatggggagttaatttttgctccagggcagctgccaagcccagcaccggcatcaatagaaggttttctctgattttcttctcttcctctcaggctaggctttcttaccaatccccaattttcttctgtagggcgccaggagactggccagagatctttagactcttacttagtttgaacatctcttgctgctcacacccaggcttcttcagcagaaagcatgacccatagtaggtactcagaaactggttgaatgaaaagccttgacatttaagggctttattctgtcatacggtagcaagaactggcctattggcatcgtattcctggcattgagctgtattgaccctgaatgtgtcctcctgaggtttttgagggtgacctaggagaaagggtctgaaaaagcactgggatccaagtgactttaaatctgcccgtggcatttcctgctgagaggcgagaaactagcatctctcccaacaggctcacatccgccaggaaggacagagcccaaaacgggggtagactttgtgggaaattcgccagttagtccgctgagattttaatctgcctcaagcacaggatgctgacaagaaaggtagaccactcccccgatcccagacaaaccccaggggtgacaacttctccatcagtatcctgagaagcaacatcaaatgcttaccaagtcagcacgtttactgagtgagtactctgacggaataaaccagcatttggagctgaacttgagaacacagggccctctgacagcagcttagggaaacacccatcccttccagattggcagaatccttccatttcatgtccttcggagacgctgtattctctttacaaatcattcatgaaactgagactcagtctcccaggggtaagtcctgggccacgtgcaaacaatggcaaatccagctcttccatgatagagaaggcaaacacacccaccttcatcctgagcctaaaaggccacctctgagcacttgggcagccactcctctgggcctcagagggccatgagcttggccaggtaggcacagcggcggggaagtcacagctgtcaggtaccggccatggtgcaggtgggaataggagatgccagagctgctttagctgaggaaagcaaacagtcagcagtgctcaaaggagcaaaacttcgaatgtgcacattgacccctgacacctgcaagcataacacagatcctaagactagagtgaagtaggaagaagaattagaaaatccagtggatgtcctgagtatagggaaccagggccgttgaaaatcagtaaaggttgattacctggggcgagaccgggtgactgtggcagtgcaggtgaaggtaccctggaccttctcagttcgctggcacataaggctccgccaataaagcgtggttctctctgtcacacacacacacacacacacacacacacacacacacacacacacacacacaatgattggagggctatatgatccagcattagcttcctggtgtgccaagcatgcttgatcgggaatttttttttattattattattttttagctgtagctgaaggcatttctcggatgtggagaggagaatggaaatcgcagaaccaaatcagtttgccctgccatatttggctgtggtctgtcattgggcatttctgatgtgcttttctggattcaggaagagctgattgtcctccgagggttgaaaaaaaaaaaacagtttcagaaacctgaatccagggccttatagttctcctcattatctatcttcttctcccttccctcgcccaagggagtgggggaaacacttttcactgcagagtttgctttaaagttttcccatcttgcgtgcattatcccttgatattaaaattattttctcagtttaatccaactcctgctgagaagctgtgtgagatttaggctgtggggtttttttcttgtactcttttggatggtgttgcatttttcactcttaacccgagggtgtgtttcagcttatgttcgttctgtttcatgcaggtttatagcacggtagagtagaaggcggcttctgatttttagggtatttttagaattcattcctgagtgaggggttcagacacccagtctcctcggaacaggggtgaggggtcgactgagctttgttgagaagcctccagttaggcttcgggcgggtctccatgttatattgtgtgtttactgagcttcccactggtagaagatgacacatttgtccatcgtcctgtgtatctgctttccagaggacaccggagcattctcctggggtcactcccacatggctgcctcacatagctgttttgcaacagcctttattgccaacacccttggaagaacatctcctgtagaagtacaagttttgcaatatggactttggaagtggttttgtgatgttcgaattttctgttagcctattgctcaagcactacagaatgtacatagtccctttggccatcctctcaccccagaatatcctaataaacattgttttcttttttaaaaaaaaaaaaaaaaaaa

SEQ ID NO: 109 - protein, 460 aa, Homo sapiens
  ref <308>: DATABASE ACCESSION NUMBER: NCBI / NP_665736.1
  ref <309>: DATABASE ENTRY DATE: 2014-03-16
  ref <313>: RELEVANT RESIDUES IN SEQ ID NO: (1)..(460)
MFLATLYFALPLLDLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGNDLLEDSPYEPVNSRLSDIFRVVPFISVEHIPKGNNCLDAAKACNLDDICKKYRSAYITPCTTSVSNDVCNRRKCHKALRQFFDKVPAKHSYGMLFCSCRDIACTERRRQTIVPVCSYEEREKPNCLNLQDSCKTNYICRSRLADFFTNCQPESRSVSSCLKENYADCLLAYSGLIGTVMTPNYIDSSSLSVAPWCDCSNSGNDLEECLKFLNFFKDNTCLKNAIQAFGNGSDVTVWQPAFPVQTTTATTTTALRVKNKPLGPAGSENEIPTHVLPPCANLQAQKLKSNVSGNTHLCISNGNYEKEGLGASSHITTKSMAAPPSCGLSPLLVLVVTALSTLLSLTETS

SEQ ID NO: 110 - DNA, 2898 bp, Homo sapiens
  ref <308>: DATABASE ACCESSION NUMBER: NCBI / NM_003360.3
  ref <309>: DATABASE ENTRY DATE: 2014-02-02
  ref <313>: RELEVANT RESIDUES IN SEQ ID NO: (1)..(2898)
gggttggttccaagtctttgctattgtgaatagtgccgcaataaacatacgtgtgcatgtgtctttatagcagcatgatttatagtcctttgggtatatacccagtaatgggatggctgggttctagatccctgaggaatcgccacattgacttgcacaatggttgaactagtttacagtcccaccaacagtgtaaaagtgttcctatttctccacatcctctccggcacctgttgtttcctgactttttaatgattgccattctaactggtgtgagatgatatctcattgtggttttgatttgcatttctctgatggccagtgatggtgagcattttttcatgtgttttttggctgcataaatgtcttcttttgagaagtgtctgttcatgattttttttttagacaaagtattagatcagatatttttggggaaaaatgctttgtgattgcttgttttgaatggtgagcattgtattttgttttaagttgttttctggttgttattacagctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccggagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcctgagccatggtggtttgaacagtatttttgaaactatgtatcatggtgtgcctgtagtgggaattccactctttggagaccattatgatactatgaccagagtacaggcaaaaggcatggggatattgctagaatggaagacagttactgaaaaagagctctatgaagcactagtgaaggttatcaataatcccagctaccgtcagagggctcagaagctttcggaaattcacaaggatcaacctggtcaccctgtcaatcgaactatctattggatagattatattattcgtcacaatggagcccatcacctacgtgccgctgtccatcagatctccttttgtcagtattttttactggatattgcctttgtgcttttgcttggtgctgccttgttatactttctcttgtcttgggtgacaaaatttatctacagaaaaatcaaaagtctgtggtctagaaataagcatagcacagttaatggacattaccacaatggaatcctcaatggcaagtacaaaagaaatggccatattaaacatgaaaagaaagtgaaatgagccaacagcccaggtgatagaaataaattggttcactcattgaatttttattgctattatttagtctaacagctactaaaagtaaaacatcagtaaacaattctaacatgcccttatgagatctactaatgaaattctgtggaattaagatggctgtaaaaagcacaaacctaaaatgcagaaatgtattttattcaaatactgatgtagagagttttggcactgaaccttttagaagccttaattatttaaatcaattcagtgactgtgtcagaccttagttttaaatcttgatatgtgcgtgtcccggatcaggaatggtttcatttttcttaataatgtgtgtgtgtgtatgtgtgtgtgtgtgtgtgtgtgtttgtgtgtgtgtgtgtgtgtcctaattaagagaatttttactggctgcttgttacatttgttgagggtacaacacactcaagaataaagtaaaaggatagtcaggatccagatgtttcttttctagcatttaatgtgtgtgaactcagaacactaccatgaaagaacacttccccccaaaactggatgcagaggaagaaaaaaaaaaaagaaatggcacagttttttgtatttttttttttagttattttttgttgttgttgtttgtattgtttttcttttctgatagagtatggccacttctgggggaaaaacatgtaattaagtaaatgtatacattggttttcacgttttacttttgttttcccactaccaataatttt

SEQ ID NO: 111 - protein, 541 aa, Homo sapiens
  ref <308>: DATABASE ACCESSION NUMBER: NCBI / NP_003351.2
  ref <309>: DATABASE ENTRY DATE: 2014-02-02
  ref <313>: RELEVANT RESIDUES IN SEQ ID NO: (1)..(541)
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLTAIELFDILDHYTKNCDLMVGNHALIQGLKKEKFDLLLVDPNDMCGFVIAHLLGVKYAVFSTGLWYPAEVGAPAPLAYVPEFNSLLTDRMNLLQRMKNTGVYLISRLGVSFLVLPKYERIMQKYNLLPEKSMYDLVHGSSLWMLCTDVALEFPRPTLPNVVYVGGILTKPASPLPEDLQRWVNGANEHGFVLVSFGAGVKYLSEDIANKLAGALGRLPQKVIWRFSGPKPKNLGNNTKLIEWLPQNDLLGHSKIKAFLSHGGLNSIFETMYHGVPVVGIPLFGDHYDTMTRVQAKGMGILLEWKTVTEKELYEALVKVINNPSYRQRAQKLSEIHKDQPGHPVNRTIYWIDYIIRHNGAHHLRAAVHQISFCQYFLLDIAFVLLLGAALLYFLLSWVTKFIYRKIKSLWSRNKHSTVNGHYHNGILNGKYKRNGHIKHEKKVK

SEQ ID NO: 112 - DNA, 6007 bp, Homo sapiens
  ref <308>: DATABASE ACCESSION NUMBER: NCBI / NM_001018111.2
  ref <309>: DATABASE ENTRY DATE: 2014-03-27
  ref <313>: RELEVANT RESIDUES IN SEQ ID NO: (1)..(6007)
agccgcgcagacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccacttcgacgcatcctgtggccaccccaacaagctcgggacatgaccatcttatgaaaatttcaagcagttcaagcactgtggctatccctggctacaccttcacaagcccggggatgaccaccaccctactagagacagtgtttcaccatgtcagccaggctggtcttgaactcctgacctcgggtgatctgcccaccttggcctcccaaagtgctgggattacagcgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcatcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtccagattcctcttgtaaaataacccactagtgcctgagctcagtgctgctggatgatgagggagatcaagaaaaagccacgtaagggactttatagatgaactagtggaatcccttcattctgcagtgagattgccgagacctgaagagggtaagtgacttgcccaaggtcagagccacttggtgacagagccaggatgagaacaaagattccatttgcaccatgccacactgctgtgttcacatgtgccttccgtccagagcagtcccgggcaggggtgaaactccagcaggtggctgggctggaaaggagggcagggctacatcctggctcggtgggatctgacgacctgaaagtccagctcccaagttttccttctcctaccccagcctcgtgtacccatcttcccaccctctatgttcttacccctccctacactcagtgtttgttcccacttactctgtcctggggcctctgggattagcacaggttattcataaccttgaaccccttgttctggattcggattttctcacatttgcttcgtgagatgggggcttaacccacacaggtctccgtgcgtgaaccaggtctgcttaggggacctgcgtgcaggtgaggagagaaggggacactcgagtccaggctggtatctcagggcagctgatgaggggtcagcaggaacactggcccattgcccctggcactccttgcagaggccacccacgatcttctttgggcttccatttccaccagggactaaaatctgctgtagctagtgagagcagcgtgttccttttgttgttcactgctcagctgatgggagtgattccctgagacccagtatgaaagagcagtggctgcaggagaggccttcccggggccccccatcagcgatgtgtcttcagagacaatccattaaagcagccaggaaggacaggctttcccctgtatatcataggaaactcagggacatttcaagttgctgagagttttgttatagttgttttctaacccagccctccactgccaaaggccaaaagctcagacagttggcagacgtccagttagctcatctcactcactctgattctcctgtgccacaggaaaagagggcctggaaagcgcagtgcatgctgggtgcatgaagggcagcctgggggacagactgttgtgggaacgtcccactgtcctggcctggagctaggccttgctgttcctcttctctgtgagcctagtggggctgctgcggttctcttgcagtttctggtggcatctcaggggaacacaaagctatgtctattccccaatataggacttttatgggctcggcagttagctgccatgtagaaggctcctaagcagtgggcatggtgaggtttcatctgattgagaagggggaatcctgtgtggaatgttgaactttcgccatggtctccatcgttctgggcgtaaattccctgggatcaagtaggaaaatgggcagaactgcttaggggaatgaaattgccatttttcgggtgaaacgccacacctccagggtcttaagagtcaggctccggctgtagtagctctgatgaaataggctatccactcgggatggcttactttttaaaagggtagggggaggggctggggaagatctgtcctgcaccatctgcctaattccttcctcacagtctgtagccatctgatatcctaggggaaaaggaaggccaggggttcacatagggccccagcgagtttcccaggagttagagggatgcgaggctaacaagttccaaaaacatctgccccgatgctctagtgtttggaggtgggcaggatggagaacagtgcctgtttgggggaaaacaggaaatcttgttaggcttgagtgaggtgtttgcttccttcttgcccagcgctgggttctctccacccagtaggttttctgttgtggtcccgtgggagaggccagactggattattcctcctttgctgatcctgggtcacacttcaccagccagggcttttgacggagacagcaaataggcctctgcaaatcaatcaaaggctgcaaccctatggcctcttggagacagatgatgactggcaaggactagagagcaggagtgcctggccaggtcggtcctgactctcctgactctccatcgctctgtccaaggagaacccggagaggctctgggctgattcagaggttactgctttatattcgtccaaactgtgttagtctaggcttaggacagcttcagaatctgacaccttgccttgctcttgccaccaggacacctatgtcaacaggccaaacagccatgcatctataaaggtcatcatcttctgccacctttactgggttctaaatgctctctgataattcagagagcattgggtctgggaagaggtaagaggaacactagaagctcagcatgacttaaacaggttgtagcaaagacagtttatcatcagctctttcagtggtaaactgtggtttccccaagctgcacaggaggccagaaaccacaagtatgatgactaggaagcctactgtcatgagagtggggagacaggcagcaaagcttatgaaggaggtacagaatattctttgcgttgtaagacagaatacgggtttaatctagtctaggcaccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacaggaatgtaaatgtcttactggaaatgacaagtttttgcttgatttttttttttaaacaaaaaatgaaatataacaagacaaacttatgataaagtatttgtcttgtagatcaggtgttttgttttgtttttttaattttaaaatgcaaccctgccccctccccagcaaagtcacagctccatttcagtaaaggttggagtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatcatttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgtaaactggttcaaaaaaaaaaaaaaaaaaaaaaaaa

SEQ ID NO: 113 - protein, 558 aa, Homo sapiens
  ref <308>: DATABASE ACCESSION NUMBER: NCBI / NP_001018121.1
  ref <309>: DATABASE ENTRY DATE: 2014-03-27
  ref <313>: RELEVANT RESIDUES IN SEQ ID NO: (1)..(558)
MRCALALSALLLLLSTPPLLPSSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLLETVFHHVSQAGLELLTSGDLPTLASQSAGITASSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 114 - DNA, 3024 bp, Homo sapiens
  ref <308>: DATABASE ACCESSION NUMBER: NCBI / NM_001005914.2
  ref <309>: DATABASE ENTRY DATE: 2014-06-14
  ref <313>: RELEVANT RESIDUES IN SEQ ID NO: (1)..(3024)
aaactttacggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcagaaaaccccagaaaaaaaaaaaaaaaaaaaa

SEQ ID NO: 115 - protein, 748 aa, Homo sapiens
  ref <308>: DATABASE ACCESSION NUMBER: NCBI / NP_001005914.1
  ref <309>: DATABASE ENTRY DATE: 2014-06-14
  ref <313>: RELEVANT RESIDUES IN SEQ ID NO: (1)..(748)
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 116 - DNA, 1338 bp, Homo sapiens
  ref <308>: DATABASE ACCESSION NUMBER: NCBI / NM_005386.2
  ref <309>: DATABASE ENTRY DATE: 2014-05-05
  ref <313>: RELEVANT RESIDUES IN SEQ ID NO: (1)..(1338)
taggtggcgggcgggtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcctggaatgctgcatttactgggtaggattcgcttttcgaaatcctccagggacacagcccattgcgagaagtgaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaaaaaaaaaaaaaaaaaaaaaaaaaaaaaaaaaaaa

SEQ ID NO: 117 - protein, 81 aa, Homo sapiens
  ref <308>: DATABASE ACCESSION NUMBER: NCBI / NP_005377.1
  ref <309>: DATABASE ENTRY DATE: 2014-05-05
  ref <313>: RELEVANT RESIDUES IN SEQ ID NO: (1)..(81)
MAAVAAASAELLIIGWYIFRVLLQVFLECCIYWVGFAFRNPPGTQPIARSEVFRYSLQKLAYTVSRTGRQVLGERRQRAPN

SEQ ID NO: 118 - DNA, 2699 bp, Homo sapiens
  ref <308>: DATABASE ACCESSION NUMBER: NCBI / NM_015232.1
  ref <309>: DATABASE ENTRY DATE: 2014-01-26
  ref <313>: RELEVANT RESIDUES IN SEQ ID NO: (1)..(2699)
aagcccctccccttctctgggccttgatttcccctcctgctcagtggggacgttcttggtcctccttcttgcccactctacccagtcgccgagtctggcgaagcagagctgtctgggggtcaccgcagcaggagggaccgagcttagatacgaaaaaagacttctacacggcaagagccacagaaaggacgctccagctggctcagcagaggggcatctctccctttcaagaacaaaaggtggcaggtacccgggggccctggggcagaacgaggtaaattctgcacggacttccacatctaagaccccagaaatctccagccggctccctccgaccgaatgagaccgtgctgcaccagttctgctgcccagccgccgacgcctgctccgacctggcctcccaaagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctgcggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacaccatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtattaatcaatgcctccccagcccgactcaccattttaccaatttcaagagatacaattaaaagttactgctagcatgggt

SEQ ID NO: 119 - protein, 759 aa, Homo sapiens
  ref <308>: DATABASE ACCESSION NUMBER: NCBI / NP_056047.1
  ref <309>: DATABASE ENTRY DATE: 2014-01-26
  ref <313>: RELEVANT RESIDUES IN SEQ ID NO: (1)..(759)
MLEHKYGGHLVSRRAACTIQTAFRQYQLSKNFEKIRNSLLESRLPRRISLRKVRSPTAESLAAEKALMEGYGLVGLPLVRSPSLPPTFAGTLTELEDSFTEQVQSLAKSIDDALSTWSLKTMCSLRESGAYQLHQALQAAAGPPGLEAEGRAPESAGPGPGDDAAETPGLPPAHSGTLMMAFRDVTVQIANQNISVSSSTALSVANCLGAQTVQAPAEPAAGKAEQGETSGREAPEAPAVGREDASAEDSCAEAAASGAADGATAPKTEEEEEEEETAEVGRGAEAEAGDLEQLSSSSTSTKSAKSGSEASASASKDALQAMILSLPRYHCENPASCKSPTLSTDTLRKRLYRIGLNLFNINPDKGIQFLISRGFIPDTPIGVAHFLLQRKGLSRQMIGEFLGNSKKQFNRDVLDCVVDEMDFSSMELDEALRKFQAHIRVQGEAQKVERLIEAFSQRYCMCNPEVVQQFHNPDTIFILAFAIILLNTDMYSPNIKPDRKMMLEDFIRNLRGVDDGADIPRELVVGIYERIQQKELKSNEDHVTYVTKVEKSIVGMKTVLSVPHRRLVCCSRLFEVTDVNKLQKQAAHQREVFLFNDLLVILKLCPKKKSSSTYTFCKSVGLLGMQFQLFENEYYSHGITLVTPLSGSEKKQVLHFCALGSDEMQKFVEDLKESIAEVTELEQIRIEWELEKQQGTKTLSFKPCGAQGDPQSKQGSPTAKREAALRERPAESTVEVLINASPARLTILPISRDTIKSYC

SEQ ID NO: 120 - DNA, 2735 bp, Homo sapiens
  ref <308>: DATABASE ACCESSION NUMBER: NCBI / NM_002427.3
  ref <309>: DATABASE ENTRY DATE: 2014-05-03
  ref <313>: RELEVANT RESIDUES IN SEQ ID NO: (1)..(2735)
acaacagtccccaggcatcaccattcaagatgcatccaggggtcctggctgccttcctcttcttgagctggactcattgtcgggccctgccccttcccagtggtggtgatgaagatgatttgtctgaggaagacctccagtttgcagagcgctacctgagatcatactaccatcctacaaatctcgcgggaatcctgaaggagaatgcagcaagctccatgactgagaggctccgagaaatgcagtctttcttcggcttagaggtgactggcaaacttgacgataacaccttagatgtcatgaaaaagccaagatgcggggttcctgatgtgggtgaatacaatgttttccctcgaactcttaaatggtccaaaatgaatttaacctacagaattgtgaattacacccctgatatgactcattctgaagtcgaaaaggcattcaaaaaagccttcaaagtttggtccgatgtaactcctctgaattttaccagacttcacgatggcattgctgacatcatgatctcttttggaattaaggagcatggcgacttctacccatttgatgggccctctggcctgctggctcatgcttttcctcctgggccaaattatggaggagatgcccattttgatgatgatgaaacctggacaagtagttccaaaggctacaacttgtttcttgttgctgcgcatgagttcggccactccttaggtcttgaccactccaaggaccctggagcactcatgtttcctatctacacctacaccggcaaaagccactttatgcttcctgatgacgatgtacaagggatccagtctctctatggtccaggagatgaagaccccaaccctaaacatccaaaaacgccagacaaatgtgacccttccttatcccttgatgccattaccagtctccgaggagaaacaatgatctttaaagacagattcttctggcgcctgcatcctcagcaggttgatgcggagctgtttttaacgaaatcattttggccagaacttcccaaccgtattgatgctgcatatgagcacccttctcatgacctcatcttcatcttcagaggtagaaaattttgggctcttaatggttatgacattctggaaggttatcccaaaaaaatatctgaactgggtcttccaaaagaagttaagaagataagtgcagctgttcactttgaggatacaggcaagactctcctgttctcaggaaaccaggtctggagatatgatgatactaaccatattatggataaagactatccgagactaatagaagaagacttcccaggaattggtgataaagtagatgctgtctatgagaaaaatggttatatctattttttcaacggacccatacagtttgaatacagcatctggagtaaccgtattgttcgcgtcatgccagcaaattccattttgtggtgttaagtgtctttttaaaaattgttatttaaatcctgaagagcatttggggtaatacttccagaagtgcggggtaggggaagaagagctatcaggagaaagcttggttctgtgaacaagcttcagtaagttatctttgaatatgtagtatctatatgactatgcgtggctggaaccacattgaagaatgttagagtaatgaaatggaggatctctaaagagcatctgattcttgttgctgtacaaaagcaatggttgatgatacttcccacaccacaaatgggacacatggtctgtcaatgagagcataatttaaaaatatatttataaggaaattttacaagggcataaagtaaatacatgcatataatgaataaatcattcttactaaaaagtataaaatagtatgaaaatggaaatttgggagagccatacataaaagaaataaaccaaaggaaaatgtctgtaataatagactgtaacttccaaataaataattttcattttgcactgaggatattcagatgtatgtgcccttcttcacacagacactaacgaaatatcaaagtcattaaagacaggagacaaaagagcagtggtaagaatagtagatgtggcctttgaattctgtttaattttcacttttggcaatgactcaaagtctgctctcatataagacaaatattcctttgcatattataaaggataaagaaggatgatgtctttttattaaaatatttcaggttcttcagaagtcacacattacaaagttaaaattgttatcaaaatagtctaaggccatggcatccctttttcataaattatttgattatttaagactaaaagttgcattttaaccctattttacctagctaattatttaattgtccagtttgtcttggatatataggctattttctaaagacttgtatagcatgaaataaaatatatcttataaagtggaagtatgtatattaaaaaagagacatccaaatttttttttaaagcagtctactagattgtgatcccttgagatatggaaggatgcctttttttctctgcatttaaaaaaatcccccagcacttcccacagtgcctattgatacttggggagggtgcttggcacttattgaatatatgatcggccatcaagggaagaactattgtgctcagagacactgttgataaaaactcaggcaaagaaaatgaaatgcatatttgcaaagtgtattaggaagtgtttatgttgtttataataaaaatatattttcaacagacaaaaaaaaaaaaaaaaaa

SEQ ID NO: 121 - protein, 471 aa, Homo sapiens
  ref <308>: DATABASE ACCESSION NUMBER: NCBI / NP_002418.1
  ref <309>: DATABASE ENTRY DATE: 2014-05-03
  ref <313>: RELEVANT RESIDUES IN SEQ ID NO: (1)..(471)
MHPGVLAAFLFLSWTHCRALPLPSGGDEDDLSEEDLQFAERYLRSYYHPTNLAGILKENAASSMTERLREMQSFFGLEVTGKLDDNTLDVMKKPRCGVPDVGEYNVFPRTLKWSKMNLTYRIVNYTPDMTHSEVEKAFKKAFKVWSDVTPLNFTRLHDGIADIMISFGIKEHGDFYPFDGPSGLLAHAFPPGPNYGGDAHFDDDETWTSSSKGYNLFLVAAHEFGHSLGLDHSKDPGALMFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRYDDTNHIMDKDYPRLIEEDFPGIGDKVDAVYEKNGYIYFFNGPIQFEYSIWSNRIVRVMPANSILWC

SEQ ID NO: 122 - DNA, 2812 bp, Homo sapiens
  ref <308>: DATABASE ACCESSION NUMBER: NCBI / NM_000787.3
  ref <309>: DATABASE ENTRY DATE: 2014-05-03
  ref <313>: RELEVANT RESIDUES IN SEQ ID NO: (1)..(2812)
accccagccatgcccgccctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaagacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacagaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtgggaaaaaaaaaaaaaaaaaaaaaaaaaaaaaaaaaaaaaaaaaaaaaaaaaaaa

SEQ ID NO: 123 - protein, 617 aa, Homo sapiens
  ref <308>: DATABASE ACCESSION NUMBER: NCBI / NP_000778.3
  ref <309>: DATABASE ENTRY DATE: 2014-05-03
  ref <313>: RELEVANT RESIDUES IN SEQ ID NO: (1)..(617)
MPALSRWASLPGPSMREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADAWSDQKGQIHLDPQQDYQLLQVQRTPEGLTLLFKRPFGTCDPKDYLIEDGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAKAFYYPEEAGLAFGGPGSSRYLRLEVHYHNPLVIEGRNDSSGIRLYYTAKLRRFNAGIMELGLVYTPVMAIPPRETAFILTGYCTDKCTQLALPPSGIHIFASQLHTHLTGRKVVTVLVRDGREWEIVNQDNHYSPHFQEIRMLKKVVSVHPGDVLITSCTYNTEDRELATVGGFGILEEMCVNYVHYYPQTQLELCKSAVDAGFLQKYFHLINRFNNEDVCTCPQASVSQQFTSVPWNSFNRDVLKALYSFAPISMHCNKSSAVRFQGEWNLQPLPKVISTLEEPTPQCPTSQGRSPAGPTVVSIGGGKG

SEQ ID NO: 124 - DNA, 5507 bp, Homo sapiens
  ref <308>: DATABASE ACCESSION NUMBER: NCBI / NM_015130.2
  ref <309>: DATABASE ENTRY DATE: 2014-05-03
  ref <313>: RELEVANT RESIDUES IN SEQ ID NO: (1)..(5507)
gcggccgcgggctctcgcggggcggcgacgccgcggggaggatgctgcttgccgcgcccgcgtcctcaccgtcctcccgggccgcctgctggggctttgttgtggcccggacgccgcgggccaccccctgaagtcgcctgccgccgccgccgccgcacctagcggacgggcgggcgggcgcgcgtgtgcccaggagtgcgcgcctgtcgcggtggtgggtgcaggactggacccacgggcccattgtgcgcccgcccgcggcagccaggaccatgtgggtgaacccggaggaggtgttgctggccaacgcgctgtggatcaccgagagggccaacccatacttcatcctgcagcggaggaagggccacgccggcgatggaggcggcggcggcggactggcgggcctgctggtgggtacccttgatgttgtgttggactccagcgcccgggtcgctccttaccgaatcttgtaccagactccagactccctggtctactggaccatcgcctgtggtggttccaggaaagaaatcactgaacactgggaatggcttgagcaaaatctcttgcagacactctccatctttgaaaatgagaatgatatcaccacatttgtgagaggaaaaatacagggcatcattgcagaatacaacaaaatcaatgatgtaaaggaagatgatgacacggagaagtttaaagaagccattgtgaaatttcataggctgtttgggatgccagaggaagagaaactcgtcaactattactcttgcagctattggaaggggaaggtcccccgtcagggttggatgtacctcagcattaaccacctttgcttttattcttttcttatgggaagggaagcgaaactggtcatccggtgggtagacatcactcagcttgagaagaatgccaccctgcttctgcctgatgtgatcaaagtgagcacacggtccagtgagcatttcttctctgtattcctcaacatcaacgagaccttcaagttaatggagcagcttgccaacatagccatgaggcaactcttagacaatgagggatttgaacaagatcgatccctgcccaaactcaaaaggaaatctcctaaaaaagtgtctgctctaaaacgtgatcttgatgccagggcaaagagtgagagataccgtgcacttttccggctgcccaaagatgaaaaattagatggccacacagactgcactctctggactccatttaacaaaatgcacattttggggcagatgtttgtgtccacaaattacatctgttttaccagcaaggaggagaacttatgtagcctcattatcccgctccgtgaggtgacaattgtggaaaaggcagacagctccagtgtgctccccagtcccttatccatcagcacccgaaacaggatgaccttcctatttgccaacttgaaagatagagactttctagtgcagaggatctcagatttcctgcaacagactacttccaaaatatattctgacaaggagtttgcaggaagttacaacagttcagatgatgaggtgtactctcgacccagcagcctcgtctcctccagcccccagagaagcacgagctctgatgctgatggagagcgccagtttaacctaaatggcaacagcgtccccacagccacacagaccctgatgaccatgtatcggcggcggtctcccgaggagttcaacccgaaattggccaaagagtttctgaaagagcaagcctggaagattcactttgctgagtatgggcaagggatctgcatgtaccgcacagagaaaacgcgggagctggtgttgaagggcatcccggagagcatgcgtggggagctctggctgctgctgtcaggtgccatcaatgagaaggccacacatcctgggtactatgaagacctagtggagaagtccatggggaagtataatctcgccacggaggagattgagagggatttacaccgctcccttccagaacacccagcttttcagaatgaaatgggcattgctgcactaaggagagtcttaacagcttatgcttttcgaaatcccaacatagggtattgccaggccatgaatattgtcacttcagtgctgctgctttatgccaaagaggaggaagctttctggctgcttgtggctttgtgtgagcgcatgctcccagattactacaacaccagagttgtgggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtatttagacagtgtgaccaataaagacagcacactgcctcccattcctcacctccactccttgctcagcgatgatgtggaaccttaccctgaggtagacatctttagactcatcagaacttcctacgagaaattcggaactatccgggcagatttgattgaacagatgagattcaaacagagactgaaagtgatccagacgctggaggatactacgaaacgcaacgtggtacgaaccattgtgacagaaacttcctttaccattgatgagctggaagaactttatgctcttttcaaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtgctgcatgccatggggacctcacagagaagctcaaactcctgtacaaaatgcacgtcttgcctgagccatcctctgatcaagatgaaccagattctgcttttgaagcaactcagtacttctttgaagatattaccccagaatgtacacatgttgttggattggatagcagaagcaaacagggtgcagatgatggctttgttacggtgagcctaaagccagacaaagggaagagagcaaattcccaagaaaatcgtaattatttgagactgtggactccagaaaataaatctaagtcaaagaatgcaaaggatttacccaaattaaatcaggggcagttcattgaactgtgtaagacaatgtataacatgttcagcgaagaccccaatgagcaggagctgtaccacgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctgacacgggcgccttcccgggggagtgggaggagagggaggggagggattttttatgttcttctgtgttgagttttttctttctttcttttaaattaaatatttattagtacctggcttgaagcctagtgttttcataatgtaattcaatgaaaactgttggagaaatatttaaacacctcaatgtaggtacattacactcttgttgcggggaggggatttaccagaatacagtttatttcgtgaattctaaaaaacaaaaagatgaatctgtcagtgatatgtgtgtattataacttattaatcttgctgttgagctgtatacatggtttaaaaaatagtactgtttaatgctaagtaaggcagcagtcatttgtgtattcaggctttttaaataaaattagagctgtaaggaaaatgaaaagccacaaatgcaagactgttcttaaatggaaggcatagtcagcgagggtaaatcctataccactttaggaagtattaaaaatatttttaagatttgaaatatatttcatagaagtcctctattcaaaatcatattccacagatgttccccttcaaagggaaaacatttggggttctaaacagttatgaaagtaagtgatttttacatgattccagaataacacttgtattgaccaatttagacagataccagaccaattttgcatttaagaaattgttctgattatttacgtcaactcattagaattcagtgaaaagtaacagtcttttgtcacagagaatctgaaagtagcagcaaagacagagggctcatgacaggtttttgcttttgctttgcttttgtttttgaaagagtaaaagtactgatgcttctgatactggatgtttagcttcttactgcaaaaacataagtaaaacagtcaactttaccatttccgtattctccatagattgaagaaatttataccacatatcgcatatgaccatctttccatcaaatcaatgtagagataatgtaaactgaaaaaaaatctgcaagataatgtaactgaatgttttaaaaacagaacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgttttttattctatttacaggatgatttttaaactgtcaaatgaagtagtgttaacctcaaataggctaaatgtgaacaaataaaatacagcaaatactcagaaaaaaaaaaaaaaaaaaaaaa

SEQ ID NO: 125 - protein, 1266 aa, Homo sapiens
  ref <308>: DATABASE ACCESSION NUMBER: NCBI / NP_055945.2
  ref <309>: DATABASE ENTRY DATE: 2014-03-19
  ref <313>: RELEVANT RESIDUES IN SEQ ID NO: (1)..(1266)
MWVNPEEVLLANALWITERANPYFILQRRKGHAGDGGGGGGLAGLLVGTLDVVLDSSARVAPYRILYQTPDSLVYWTIACGGSRKEITEHWEWLEQNLLQTLSIFENENDITTFVRGKIQGIIAEYNKINDVKEDDDTEKFKEAIVKFHRLFGMPEEEKLVNYYSCSYWKGKVPRQGWMYLSINHLCFYSFLMGREAKLVIRWVDITQLEKNATLLLPDVIKVSTRSSEHFFSVFLNINETFKLMEQLANIAMRQLLDNEGFEQDRSLPKLKRKSPKKVSALKRDLDARAKSERYRALFRLPKDEKLDGHTDCTLWTPFNKMHILGQMFVSTNYICFTSKEENLCSLIIPLREVTIVEKADSSSVLPSPLSISTRNRMTFLFANLKDRDFLVQRISDFLQQTTSKIYSDKEFAGSYNSSDDEVYSRPSSLVSSSPQRSTSSDADGERQFNLNGNSVPTATQTLMTMYRRRSPEEFNPKLAKEFLKEQAWKIHFAEYGQGICMYRTEKTRELVLKGIPESMRGELWLLLSGAINEKATHPGYYEDLVEKSMGKYNLATEEIERDLHRSLPEHPAFQNEMGIAALRRVLTAYAFRNPNIGYCQAMNIVTSVLLLYAKEEEAFWLLVALCERMLPDYYNTRVVGALVDQGVFEELARDYVPQLYDCMQDLGVISTISLSWFLTLFLSVMPFESAVVVVDCFFYEGIKVIFQLALAVLDANVDKLLNCKDDGEAMTVLGRYLDSVTNKDSTLPPIPHLHSLLSDDVEPYPEVDIFRLIRTSYEKFGTIRADLIEQMRFKQRLKVIQTLEDTTKRNVVRTIVTETSFTIDELEELYALFKAEHLTSCYWGGSSNALDRHDPSLPYLEQYRIDFEQFKGMFALLFPWACGTHSDVLASRLFQLLDENGDSLINFREFVSGLSAACHGDLTEKLKLLYKMHVLPEPSSDQDEPDSAFEATQYFFEDITPECTHVVGLDSRSKQGADDGFVTVSLKPDKGKRANSQENRNYLRLWTPENKSKSKNAKDLPKLNQGQFIELCKTMYNMFSEDPNEQELYHATAAVTSLLLEIGEVGKLFVAQPAKEGGSGGSGPSCHQGIPGVLFPKKGPGQPYVVESVEPLPASLAPDSEEHSLGGQMEDIKLEDSSPRDNGACSSMLISDDDTKDDSSMSSYSVLSAGSHEEDKLHCEDIGEDTVLVRSGQGTAALPRSTSLDRDWAITFEQFLASLLTEPALVKYFDKPVCMMARITSAKNIRMMGKPLTSASDYEISAMSG

SEQ ID NO: 126 - DNA, 683 bp, Homo sapiens
  ref <308>: DATABASE ACCESSION NUMBER: NCBI / NM_014624.3
  ref <309>: DATABASE ENTRY DATE: 2014-03-02
  ref <313>: RELEVANT RESIDUES IN SEQ ID NO: (1)..(683)
ctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 127 - protein, 90 aa, Homo sapiens
  ref <308>: DATABASE ACCESSION NUMBER: NCBI / NP_055439.1
  ref <309>: DATABASE ENTRY DATE: 2014-03-02
  ref <313>: RELEVANT RESIDUES IN SEQ ID NO: (1)..(90)
MACPLDQAIGLLVAIFHKYSGREGDKHTLSKKELKELIQKELTIGSKLQDAEIARLMEDLDRNKDQEVNFQEYVTFLGALALIYNEALKG

SEQ ID NO: 128 - DNA, 3388 bp, Homo sapiens
  ref <308>: DATABASE ACCESSION NUMBER: NCBI / NM_178496.3
  ref <309>: DATABASE ENTRY DATE: 2014-02-02
  ref <313>: RELEVANT RESIDUES IN SEQ ID NO: (1)..(3388)
agttggctctacgaccgccgttgccgctgccagagagggccagggcagggcagggacgcgcagcatcggggcgggcgtggggccggagaaaagggtgtcggggccacacacgcaccctcgctgcagtccagctcctcccgaagctcgcacgcccagagcgcacggagcgggggactgcccgcccagacgcccgcccgccaacccgcccacgagccggggccaaagcctgggagcctgcgaggggaggaggcccaggggggcggggtggggggcgggggtgggtgccgcgctgccgcggagctgctactcggcgcgttttgcatgaagatggcggctcccaccgccaacaaggcagcctccctgggctgtaacaacaagcctgcgttcccggagctggatttcaggtcgggagctcgggtggaggaattgaacaaactcatccaagaatttacgaagcacgaccagcgggaatacgacgaccagagagcgctggagattcacacagccaaggatttcatcttttccatgctgggaatggtgcaaaagctggaccaaaagcttccagtggctaatgaatacctgttgctctctggaggtgtccgggaaggcgtggtggacctggacttagatgagcttaatgtctatgcccggggtactgactatgatatggactttaccctcttggtgccagccctcaagctgcatgaccgtaatcagcctgtgacactcgacatgcgccactcagccttgtgccactcttggctgagccttcggctctttgatgaggggacaatcagtaaatggaaagactgctgcaccattgtagatcacatcaatggtgccaccaactacttcttctcacctaccaaagtggctgactggttctatgactctatcagcattgtcctatcagaaatacagaagaaaccccagcgagggatgccaaaggtagaaaaggtggaaaaaaatgggaccatcatctccatcattctgggtgtagggagtagtcgcatgttgtatgatattgtccctgtggtatctttcaaaggttggcctgcagtggcccagagctggctcatggagaaccacttttgggatgggaagattactgaggaagaggtcatcagtgggttttacttggtgcctgcttgctcctacaagggtaagaaggacaatgaatggcggctgtcctttgccaggagcgaggtgcagttgaagaagtgcatctccagcagcctcatgcaggcctatcaggcctgcaaagccatcatcattaaactgctgtcccggcccaaggctattagcccctatcacctgcggagcatgatgctctgggcctgcgacagacttcctgccaactacttggctcaagaagactatgcagcccactttttgctgggcctcatcgatgacctgcaacactgtctggtcaacaagatgtgccccaattatttcatccctcagtgcaacatgctggaacatctgtctgaggagacagtcatgcttcacgcccggaagctgtcctctgtgcgctcagacccggcagagcacttgcgcaccgccattgagcatgtcaaggcagccaaccggctgacactggagctccagaggcgaggtagcaccaccagcatcccctctccacagtctgacggaggggaccccaaccagcctgatgaccgtttggcaaaaaaactgcagcagctagtgactgagaacccgggaaagtcaatctctgtctttatcaatcctgacgatgtcacaaggccccatttcagaattgatgacaaatttttctgagtgttagctgacttttttttttcctgattcttaaactctgataatgtgtcgtgtggtttgtgatgctatctttctgttttttacatatccagcctagattggatttgttaagaacaaattttaagtttcctggttctgcaggatggtgcaggctctgaaacagtatattactatttcatattctgcctctgatttcgttgtttactttttgtagttattgtcatgctctttagtttgttggagttttttttctttttaaggagatcttaagccatagatgaaaatgcccatgaatcctcttgcttttttctgtttcatacttggtgcaaatttgttcatgggtatggggaaacaaatctctttctgatgcttaacgattctatcctattatttttattattttgtttttgtcttttttcttatgagctttcaccactactgatatttgagaatcatatgaacctgggaactacttggcatgttagctggatttatttattttggccagtgaccagagtagtttccccccttttccaccaaacaatgtaaactttgaaagtgataatactacaaattgtgttttggagcaacttcattgaatgtaattgtcctcaaatcagagaacactgggtggtttgaagggtgtctttgacagttttccaagcagaattaaggtttccaaatgttaattttagcatatgtaattatttgaagccttatttaaatcctattaaagaacataccattataattattatttgcactaatctttgccattgtcagaattgcaaagtgtgtttcaatataaattaacaaccactctcgaaattctatcattttttcattttgcccatttctatcagtgaaatgattctttgcatttgcttagttctccttcagttgtggggtcctgctttgccctctttgatattcctggttcctgtcttactgagagaagttgttaaagctttatacatgttgaccccatctaaagctggggaaaatatacacttgatgaagtaggtgtctttgtatttatttcttttggggtcatagaggtaagcttttttgtaaaatctctactcttcctgagagttttgagaaaaactggcaggaagaacttataatccccaaatagaagataccacgtctgttcaaaagcaggtattgctatagagcagcacccaggaaatatctgtgggtggcagccttggtatagaggtgtcctgtcttcatgagtgaagttacttgcctgattaggtgctggaaggtattggctccctgttttggtgtggactcatggcaagctggtgtttaagaggtcaggaggcctgctgatctttcaaaggacacccatgatgtctactcatagaaagggcaagtaacgtgttcattttggtcttgaatgtccaaactcaagggttggattttggccaattgaaatcagacatatgcgatcttgggtttttgcatggaaattaatgtaatgcttataaatgaaaaatgaaaacatttcaaccatctaagtcaaacacaaaaataataaaaaaagaaacatactggccttgaaaaaaaaaaaaaaaaaaaaaaa

SEQ ID NO: 129 - protein, 491 aa, Homo sapiens
  ref <308>: DATABASE ACCESSION NUMBER: NCBI / NP_848591.2
  ref <309>: DATABASE ENTRY DATE: 2014-02-02
  ref <313>: RELEVANT RESIDUES IN SEQ ID NO: (1)..(491)
MKMAAPTANKAASLGCNNKPAFPELDFRSGARVEELNKLIQEFTKHDQREYDDQRALEIHTAKDFIFSMLGMVQKLDQKLPVANEYLLLSGGVREGVVDLDLDELNVYARGTDYDMDFTLLVPALKLHDRNQPVTLDMRHSALCHSWLSLRLFDEGTISKWKDCCTIVDHINGATNYFFSPTKVADWFYDSISIVLSEIQKKPQRGMPKVEKVEKNGTIISIILGVGSSRMLYDIVPVVSFKGWPAVAQSWLMENHFWDGKITEEEVISGFYLVPACSYKGKKDNEWRLSFARSEVQLKKCISSSLMQAYQACKAIIIKLLSRPKAISPYHLRSMMLWACDRLPANYLAQEDYAAHFLLGLIDDLQHCLVNKMCPNYFIPQCNMLEHLSEETVMLHARKLSSVRSDPAEHLRTAIEHVKAANRLTLELQRRGSTTSIPSPQSDGGDPNQPDDRLAKKLQQLVTENPGKSISVFINPDDVTRPHFRIDDKFF

SEQ ID NO: 130 - DNA, 6112 bp, Homo sapiens
  ref <308>: DATABASE ACCESSION NUMBER: NCBI / NM_004938.3
  ref <309>: DATABASE ENTRY DATE: 2014-05-05
  ref <313>: RELEVANT RESIDUES IN SEQ ID NO: (1)..(6112)
agagcgcgccagcgagcccggagcgcggagctgggaggagcagcgagcgccgcgcagaacccgcagcgccggcctggcagggcagctcggaggtgggtgggccgcgccgccagcccgcttgcagggtccccattggccgcctgccggccgccctccgcccaaaaggcggcaaggagccgagaggctgcttcggagtgtgaggaggacagccggaccgagccaacgccggggactttgttccctccgcggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgcattaaaaaaaaaaaaaaa

SEQ ID NO: 131 - protein, 1430 aa, Homo sapiens
  ref <308>: DATABASE ACCESSION NUMBER: NCBI / NP_004929.2
  ref <309>: DATABASE ENTRY DATE: 2014-05-05
  ref <313>: RELEVANT RESIDUES IN SEQ ID NO: (1)..(1430)
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKHGTPPLLIAAGCGNIQILQLLIKRGSRIDVQDKGGSNAVYWAARHGHVDTLKFLSENKCPLDVKDKSGEMALHVAARYGHADVAQLLCSFGSNPNIQDKEEETPLHCAAWHGYYSVAKALCEAGCNVNIKNREGETPLLTASARGYHDIVECLAEHGADLNACDKDGHIALHLAVRRCQMEVIKTLLSQGCFVDYQDRHGNTPLHVACKDGNMPIVVALCEANCNLDISNKYGRTPLHLAANNGILDVVRYLCLMGASVEALTTDGKTAEDLARSEQHEHVAGLLARLRKDTHRGLFIQQLRPTQNLQPRIKLKLFGHSGSGKTTLVESLKCGLLRSFFRRRRPRLSSTNSSRFPPSPLASKPTVSVSINNLYPGCENVSVRSRSMMFEPGLTKGMLEVFVAPTHHPHCSADDQSTKAIDIQNAYLNGVGDFSVWEFSGNPVYFCCYDYFAANDPTSIHVVVFSLEEPYEIQLNQVIFWLSFLKSLVPVEEPIAFGGKLKNPLQVVLVATHADIMNVPRPAGGEFGYDKDTSLLKEIRNRFGNDLHISNKLFVLDAGASGSKDMKVLRNHLQEIRSQIVSVCPPMTHLCEKIISTLPSWRKLNGPNQLMSLQQFVYDVQDQLNPLASEEDLRRIAQQLHSTGEINIMQSETVQDVLLLDPRWLCTNVLGKLLSVETPRALHHYRGRYTVEDIQRLVPDSDVEELLQILDAMDICARDLSSGTMVDVPALIKTDNLHRSWADEEDEVMVYGGVRIVPVEHLTPFPCGIFHKVQVNLCRWIHQQSTEGDADIRLWVNGCKLANRGAELLVLLVNHGQGIEVQVRGLETEKIKCCLLLDSVCSTIENVMATTLPGLLTVKHYLSPQQLREHHEPVMIYQPRDFFRAQTLKETSLTNTMGGYKESFSSIMCFGCHDVYSQASLGMDIHASDLNLLTRRKLSRLLDPPDPLGKDWCLLAMNLGLPDLVAKYNTSNGAPKDFLPSPLHALLREWTTYPESTVGTLMSKLRELGRRDAADFLLKASSVFKINLDGNGQEAYASSCNSGTSYNSISSVVSR

SEQ ID NO: 132 - DNA, 5802 bp, Homo sapiens
  ref <308>: DATABASE ACCESSION NUMBER: NCBI / NM_005458.7
  ref <309>: DATABASE ENTRY DATE: 2014-05-25
  ref <313>: RELEVANT RESIDUES IN SEQ ID NO: (1)..(5802)
gccgcccctgagcagcctcgccttcgcctcccgcgtttcctgccgtccgccctcccccggccgagctccaggggctgccgcctagcagctcccggcgggagagcggttcagagcgcgcacgggggcgggcggaggcggcccggtgcggggcggccgcgctggagagaggcgcgcgcggagacgccggcccccctctccgcgtttgctcgcttgctccccgcctcccgcactccgctcgctcccaccccttcccggcgtgattgatccgtcacgggcgccgccgctgccgccgccgccgccgcggccgttctgagccgagccggaaccctagcccgagacggagccggggcccgggccggcgccattgcgcgggcgccgcgggaagaccttggcgcggggcggcgggccgggccaggccatgcgggccgagtgagccggcgcccgcagcccgcggcgcggcatggcttccccgcggagctccgggcagcccgggccgccgccgccgccgccaccgccgcccgcgcgcctgctactgctactgctgctgccgctgctgctgcctctggcgcccggggcctggggctgggcgcggggcgccccccggccgccgcccagcagcccgccgctctccatcatgggcctcatgccgctcaccaaggaggtggccaagggcagcatcgggcgcggtgtgctccccgccgtggaactggccatcgagcagatccgcaacgagtcactcctgcgcccctacttcctcgacctgcggctctatgacacggagtgcgacaacgcaaaagggttgaaagccttctacgatgcaataaaatacgggcctaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcctacctcccatccatcggaggcgtggacgccagctgtgtcagcccctgcgtcagccccaccgccagcccccgccacagacatgtgccaccctccttccgagtcatggtctcgggcctgtaagggtgggaggcctgggcccggggcctcccccgtgacagaaccacactgggcagaggggtctgctgcagaaacactgtcggctctggctgcggagaagctgggcaccatggctggcctctcaggaccactcggatggcactcaggtggacaggacggggcagggggagacttggcacctgacctcgagccttatttgtgaagtccttatttcttcacaaagaagaggaacggaaatgggacgtcttccttaacatctgcaaacaaggaggcgctgggatatcaaacttgcaaaaaaaaaaaaaaaaaaaaaaaaacaaaaaaactagacaaggagagaggcactagaactccagctggaagtcacggagtggctcgagcagccttgggaagaggcaaggagcttctgaagaaactgcctctgcacacacatcactggctgtgacccctcaggctagcccttctccactctgggggaggaggtgggaagggccaccaggcccccagctgccaggccagctgaccccagccttcctggaacagggagtctgcaggagcgcagacaggcacagccctggagcaggcaggccgagggctgcggcactggagcaggctgacttacatgctccacatgggacctgtgtcacccaatgagatgtttgttactctggtaaatgccacacgttaacacaataacacccattcctgggaccgtggggatttagggcacgtcactgcagacacgctctgcagcattcaccgacagtctgtcatgcacccaccacgttggccatgtccttgtgttcctatcggatgctcccagtaaccagggggaccacccgagctaatcatggaatgtctgttcccagcaaacacgataaagaaagattgtgcactttaacctctctcatcagggcccaagggctggctgggattttttttttttttttcccactaactttgtttctgaccaaagtgaattggaggcactctgctaaaagacatccccgtagacataggggagagagttgctggctgagggcttcccttggcttccagaaggcagccttccatccagacaagccagtgagctctccccttgggatcactggggtgatcagtcagcagattgattctcattcataagatcattcctccctttaaattgagcccctaagagcactggcctgggagtcagacagacctgggttcaagtcctcagtcccctgcccactccctacgtgactttgatcaggtcactagtgtctctctgagcctcagtttcccctctgtaacttggggttgaactaaaacacctgtcctgcctacctcacaaggtcactctgaggattgaaacttgatcttgtccaggaaagctttgtaccaaacagtgaagccgccctgatccgtgaggtatgagtatgactctgaccttcagccctccctacagccgggggtgtggcccagagaagcttccagcacagccctctacccagaacatccgggctggagggaggctcccagtgacttttctgacattcctagacaggttcattctttgctcaagaaaggcctgaatgacaatgtccaggatgtctgcacaactgagcagctcgctcactccctaaagaaacctattggcagcttcaacaggcaggcaataatctcttcccagaaccactgcagtcaggaataaactgttttctccaccaggctttgacaaaagggcccacaggaatcttaccaatgccaacatttcaaagcaccctatttcacgtagcatagctttctgctccccttccccaaagagaggttatggaggtactgtagcttttagggaaaaaaaaatgttaacacatcacaggtcaagttgaagtcattctctgtttaggcactaaaaatcggtgttgtcactcactgtgtattaccagtatttacttgctttcttgatttcaccaaaaccaaatttaatttaaaggaccacattaatttttcaaagggaaagagacaattaattgtacataatgtatacacacacacaaaaaaaaatacctgtagaaatattattccagcatagcaggaaaacaaacaaaagtattggactgtcggaggtgagcctgtgcgtctgtaaccctttgtgactcctgagcgtgcgctgtcttctaggttaactcacgaagtacattctctgtcttactgatactgtaggttcacccatttttttttaatttcctcgcaaataacaagacccacagaagtgactctagctacttaatggttctgttcttttatatgcagcaaacacaccgtccatttctgaagaggcttcggcctgaaggcattttccaatgatgttagtgcacaaaacgctttaaattagactggaactgccagaatcaaatgtaaatgaggaatttctcgtacccctactgcatggtatcgatttttaataaattgttgcaaatttgtttttatgaataaaaggaaaaaacctgtcgtctttaaaaaaaaaaaaaaaa

SEQ ID NO: 133 - protein, 941 aa, Homo sapiens
  ref <308>: DATABASE ACCESSION NUMBER: NCBI / NP_005449.5
  ref <309>: DATABASE ENTRY DATE: 2014-05-25
  ref <313>: RELEVANT RESIDUES IN SEQ ID NO: (1)..(941)
MASPRSSGQPGPPPPPPPPPARLLLLLLLPLLLPLAPGAWGWARGAPRPPPSSPPLSIMGLMPLTKEVAKGSIGRGVLPAVELAIEQIRNESLLRPYFLDLRLYDTECDNAKGLKAFYDAIKYGPNHLMVFGGVCPSVTSIIAESLQGWNLVQLSFAATTPVLADKKKYPYFFRTVPSDNAVNPAILKLLKHYQWKRVGTLTQDVQRFSEVRNDLTGVLYGEDIEISDTESFSNDPCTSVKKLKGNDVRIILGQFDQNMAAKVFCCAYEENMYGSKYQWIIPGWYEPSWWEQVHTEANSSRCLRKNLLAAMEGYIGVDFEPLSSKQIKTISGKTPQQYEREYNNKRSGVGPSKFHGYAYDGIWVIAKTLQRAMETLHASSRHQRIQDFNYTDHTLGRIILNAMNETNFFGVTGQVVFRNGERMGTIKFTQFQDSREVKVGEYNAVADTLEIINDTIRFQGSEPPKDKTIILEQLRKISLPLYSILSALTILGMIMASAFLFFNIKNRNQKLIKMSSPYMNNLIILGGMLSYASIFLFGLDGSFVSEKTFETLCTVRTWILTVGYTTAFGAMFAKTWRVHAIFKNVKMKKKIIKDQKLLVIVGGMLLIDLCILICWQAVDPLRRTVEKYSMEPDPAGRDISIRPLLEHCENTHMTIWLGIVYAYKGLLMLFGCFLAWETRNVSIPALNDSKYIGMSVYNVGIMCIIGAAVSFLTRDQPNVQFCIVALVIIFCSTITLCLVFVPKLITLRTNPDAATQNRRFQFTQNQKKEDSKTSTSVTSVNQASTSRLEGLQSENHRLRMKITELDKDLEEVTMQLQDTPEKTTYIKQNHYQELNDILNLGNFTESTDGGKAILKNHLDQNPQLQWNTTEPSRTCKDPIEDINSPEHIQRRLSLQLPILHHAYLPSIGGVDASCVSPCVSPTASPRHRHVPPSFRVMVSGL

SEQ ID NO: 134 - DNA, 3318 bp, Homo sapiens
  ref <308>: DATABASE ACCESSION NUMBER: NCBI / NM_002069.5
  ref <309>: DATABASE ENTRY DATE: 2014-04-06
  ref <313>: RELEVANT RESIDUES IN SEQ ID NO: (1)..(3318)
ggaggccgagctcggctgggcttggcgaggctgcggcgcggccaccggcgggagtgcagcggccactgtacccagagattcaaaaccccaaacccgggacttgggggcgctgagccgggccgggaagcagagcctggtcgtgaggaacagccgcccgttgctgtctgcccctttgcggacagcgtctccctcgactccgcttaggaagtggtgggggcggcgtggcccccgtcgggaggcgttcgaacgcccgctaggagagagaaaggattcccctgtgcttggagcccgcactcgggcgcggagggagcggcggcaggctctcgctttcggcaccatgggctgcacgctgagcgccgaggacaaggcggcggtggagcggagtaagatgatcgaccgcaacctccgtgaggacggcgagaaggcggcgcgcgaggtcaagctgctgctgctcggtgctggtgaatctggtaaaagtacaattgtgaagcagatgaaaattatccatgaagctggttattcagaagaggagtgtaaacaatacaaagcagtggtctacagtaacaccatccagtcaattattgctatcattagggctatggggaggttgaagatagactttggtgactcagcccgggcggatgatgcacgccaactctttgtgctagctggagctgctgaagaaggctttatgactgcagaacttgctggagttataaagagattgtggaaagatagtggtgtacaagcctgtttcaacagatcccgagagtaccagcttaatgattctgcagcatactatttgaatgacttggacagaatagctcaaccaaattacatcccgactcaacaagatgttctcagaactagagtgaaaactacaggaattgttgaaacccattttactttcaaagatcttcattttaaaatgtttgatgtgggaggtcagagatctgagcggaagaagtggattcattgcttcgaaggagtgacggcgatcatcttctgtgtagcactgagtgactacgacctggttctagctgaagatgaagaaatgaaccgaatgcatgaaagcatgaaattgtttgacagcatatgtaacaacaagtggtttacagatacatccattatactttttctaaacaagaaggatctctttgaagaaaaaatcaaaaagagccctctcactatatgctatccagaatatgcaggatcaaacacatatgaagaggcagctgcatatattcaatgtcagtttgaagacctcaataaaagaaaggacacaaaggaaatatacacccacttcacatgtgccacagatactaagaatgtgcagtttgtttttgatgctgtaacagatgtcatcataaaaaataatctaaaagattgtggtctcttttaagttttgcagttcatggtaaaatgcattttcaaaccaaatgagtacttatatatggatctctgtagactagagtcttgcagcaacacagaatgtaatataaggcaaatgcatctgggacttgaccaaagttgttctgttttgtttttttaactgaaagtaacagaaggacctttcttaaatgtgacagatggtcctgcagtgtgaaactgaaggacagtgttaaagctgggctctagtatattgatgatttctgcataagtgtaaatatgcaaatgtatgtatacatgtatttatgactttagttttcgacattatttttaggttttaagagtggcaacttaggattttagggtgatggctttggaaataacataaatataccttgtactgaatgacagactattactacgtttgccagttttaaacagctttatttatgttcatgtcctgtaaatttttaagtacagtaattaatattaggaaacattacagcccttatctagattatatgtatacttgtattaataaaaatgttatttgtacaaacattgcacagactattttaataacatgatttgttctttaaattttatgtgttttattgaaatgttcttaagatgaatacacctgcctttggatcaactatttaaacattgtatgcattttgatttttcctactttaagaaaataaaataatttaattttacattagattccacgttagatttggtttgaaaaactaaaatttcagatttctgaggatatactgtcttagacttattgtacacacttagtttttattcacttgttttcactctgaattttaatatttggctgatatgaatgcattgcctcaaaggtgatgtcatcttaatttttattcactttaaataactacatttttgtttataactaagtttggagggatcctaagagcatttttgtgggtaaaaaaaaaacctgtggacataatgaattttgagacattgattggtgaggcttttatttcccttgaggagtctcttgtacctagcatacatgatagctccttgttgggaagataacaagaaggatctttgaatactctattgctgatataatgcaagatttaaatttatacatataactaatttcaaatgtaattatcacactatgttaaaattacttttttcccttagataattcaaatttctccacttgcttgagattatatcatttctttttcaattatactattatttctgagaatgaaatggacgattacacttagaaaatgagtaatagtgtttaataagtcagtgattatatgtgtgctcaaataagtgttatgtatcagctagatactgagctttgatagaataattttcttttgattattcatgatgtgtcatctctgaccttgtttcagcaaagtaaacagcactccccaccccaccctcctttttttactcatcttggaaaaggttagtctttcagtacacgttgctggtaagtagtttccaagttacgtgttgtcactgggttgaagtatatttgtgtgtgtgtgtgtgtgtgtgtgtgtgtgtgtaaccataaactatattcatatctgtttcatttggaggattttcttctttgtaatgtaaagaaattcaaagttatcaaagttccttaaatgtgttagtttagattctttatgtgcctttcatgaaagatatgttttcattaattttactggtggacctgtaatatccacattgtgaagctgtgtatgaaattcaactataatatgaataaatttgaatcatgagaattatgggttaaaaagccacaaagaagcacatattggtgaccatcattaatgaaatcctgaactttattctgtgtaattgtgttaataaatcctaataaatttaaatttttaaaattttacaaac

SEQ ID NO: 135 - protein, 354 aa, Homo sapiens
  ref <308>: DATABASE ACCESSION NUMBER: NCBI / NP_002060.4
  ref <309>: DATABASE ENTRY DATE: 2014-04-06
  ref <313>: RELEVANT RESIDUES IN SEQ ID NO: (1)..(354)
MGCTLSAEDKAAVERSKMIDRNLREDGEKAAREVKLLLLGAGESGKSTIVKQMKIIHEAGYSEEECKQYKAVVYSNTIQSIIAIIRAMGRLKIDFGDSARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTKNVQFVFDAVTDVIIKNNLKDCGLF

SEQ ID NO: 136 - DNA, 4197 bp, Homo sapiens
  ref <308>: DATABASE ACCESSION NUMBER: NCBI / NM_000623.3
  ref <309>: DATABASE ENTRY DATE: 2014-04-27
  ref <313>: RELEVANT RESIDUES IN SEQ ID NO: (1)..(4197)
atcactacccagcccttgaaagatgagctgttcccgccgccactccagctctggcttctgggctccgaggaggggtggggacggtggggacggtggggacatcaggctgccccgcagtaccagggagcgactgaagtgcccatgccgcttgctccggagaaggtgtggcctcactcacatcccactctgagtccaaatgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacagagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccatctgtccctgcctcagttccctcttctgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaactggagaggctagaaccaagaagggctagaacctggaggggctagaacctagagaagctaaaacctgagctagaagctggaggactagaacctggagggctggaatctggagagctagaacctggagggctagaacctggagggctagaatctggagagctagaacctggagggctagaatctggagagctagaacctggagggctagaacctggagagctagaacctagaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtcaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcatagctctagcatttgttacaactcccgaaacccccgagtttggtccctggggtaccgccttgcacactcagaagcctttgggaaggggtgctattcatttctgctcaatctgttaacaggcttctggcatgtagatcagtggtctccaagcttttgtgattgtat

SEQ ID NO: 137 - protein, 391 aa, Homo sapiens
  ref <308>: DATABASE ACCESSION NUMBER: NCBI / NP_000614.1
  ref <309>: DATABASE ENTRY DATE: 2014-04-27
  ref <313>: RELEVANT RESIDUES IN SEQ ID NO: (1)..(391)
MFSPWKISMFLSVREDSVPTTASFSADMLNVTLQGPTLNGTFAQSKCPQVEWLGWLNTIQPPFLWVLFVLATLENIFVLSVFCLHKSSCTVAEIYLGNLAAADLILACGLPFWAITISNNFDWLFGETLCRVVNAIISMNLYSSICFLMLVSIDRYLALVKTMSMGRMRGVRWAKLYSLVIWGCTLLLSSPMLVFRTMKEYSDEGHNVTACVISYPSLIWEVFTNMLLNVVGFLLPLSVITFCTMQIMQVLRNNEMQKFKEIQTERRATVLVLVVLLLFIICWLPFQISTFLDTLHRLGILSSCQDERIIDVITQIASFMAYSNSCLNPLVYVIVGKRFRKKSWEVYQGVCQKGGCRSEPIQMENSMGTLRTSISVERQIHKLQDWAGSRQ

SEQ ID NO: 138 - DNA, 114 bp, Homo sapiens
gatcttcacagctgtgacatggttattccataatccatccccaagaggagcccacccaaagcaaaaaatcaaatctatccatccattataagatgatccatccatagactatat

SEQ ID NO: 139 - DNA, 23 bp, Homo sapiens
tccatccattataagatgatcca

SEQ ID NO: 140 - DNA, 23 bp, Homo sapiens
tccatccagcgtaagatgatcca

SEQ ID NO: 141 - DNA, 23 bp, Homo sapiens
tccatccattagcggatgatcca

SEQ ID NO: 142 - DNA, 23 bp, Homo sapiens
tccatccattataagcggatcca

SEQ ID NO: 143 - DNA, 23 bp, Homo sapiens
tccatccagcggtcgcagatcca

SEQ ID NO: 144 - DNA, 23 bp, Homo sapiens
tccatccaaaataagatgatcca

SEQ ID NO: 145 - DNA, 23 bp, Homo sapiens
tccatccattaaaagatgatcca

SEQ ID NO: 146 - DNA, 23 bp, Homo sapiens
tccatccaaaaaaaaaagatcca

SEQ ID NO: 147 - DNA, 23 bp, Homo sapiens
tccatccattttaagatgatcca

SEQ ID NO: 148 - DNA, 23 bp, Homo sapiens
tccatccattatttgatgatcca

SEQ ID NO: 149 - DNA, 22 bp, Homo sapiens
tccatccattttttttgatcca

SEQ ID NO: 150 - DNA, 25 bp, Homo sapiens
acagtgatgaagatgagttccaaat

SEQ ID NO: 151 - DNA, 25 bp, Homo sapiens
gataagaactctggcatcctgactc

SEQ ID NO: 152 - DNA, 27 bp, Homo sapiens
atgaaggaaacaaagtaaaaataagca

SEQ ID NO: 153 - DNA, 25 bp, Homo sapiens
gtcatcatggacaactttgagtacc

SEQ ID NO: 154 - DNA, 23 bp, Homo sapiens
agtctcgggtgaggtactcaaag

SEQ ID NO: 155 - DNA, 21 bp, Homo sapiens
gacaacaccgtccacttcaat

SEQ ID NO: 156 - DNA, 21 bp, Homo sapiens
aatcttgatgtccagggctgt

SEQ ID NO: 157 - DNA, 20 bp, Homo sapiens
ccgacaaacagcagatggac

SEQ ID NO: 158 - DNA, 22 bp, Homo sapiens
ctagcgtcttctgggacagatt

SEQ ID NO: 159 - DNA, 20 bp, Homo sapiens
agagcaaggccaagaagctg

SEQ ID NO: 160 - DNA, 20 bp, Homo sapiens
cagcttcttggccttgctct

SEQ ID NO: 161 - DNA, 20 bp, Homo sapiens
ggacacccctcatgttccag

SEQ ID NO: 162 - DNA, 20 bp, Homo sapiens
gaaagcggcctcaaggagag

SEQ ID NO: 163 - DNA, 21 bp, Homo sapiens
cgtcttctggaacatctcctg

SEQ ID NO: 164 - DNA, 21 bp, Homo sapiens
agtagccatctctgcccatct

SEQ ID NO: 165 - protein, 7 aa, Homo sapiens
MIMEYYR

SEQ ID NO: 166 - protein, 5 aa, Homo sapiens
MIMEY

SEQ ID NO: 167 - DNA, 19 bp, Homo sapiens
atctacgcagccccatggg

SEQ ID NO: 168 - DNA, 21 bp, Homo sapiens
atctacgcagccatccatggg

SEQ ID NO: 169 - DNA, 20 bp, Homo sapiens
atctacgcagccaccatggg

SEQ ID NO: 170 - DNA, 54 bp, Homo sapiens
gagcccaccccaaagcaaaaaatcaaatctatccatccattataagatgatcca

SEQ ID NO: 171 - DNA, 51 bp, Homo sapiens
atatgacacccagcaagggatatcttgtttatagacttaaaaacaccaaac

SEQ ID NO: 172 - DNA, 47 bp, Homo sapiens
agaccatcatggccaacatggtgaaaccccgtctctactaaaaatac

SEQ ID NO: 173 - DNA, 49 bp, Homo sapiens
gagaccagcctgaccaacatggagaaactccgtctctactaaaaataca

SEQ ID NO: 174 - DNA, 50 bp, Homo sapiens
  misc_feature (14)..(14): n is a, c, g, or t
  misc_feature (21)..(23): n is a, c, g, or t
  misc_feature (31)..(31): n is a, c, g, or t
  misc_feature (34)..(34): n is a, c, g, or t
  misc_feature (46)..(46): n is a, c, g, or t
gagaccaccctgancaacatnnngaaactcngtntctactaaaaanacaa

SEQ ID NO: 175 - DNA, 23 bp, Homo sapiens
tccatccagcggtcgatgatcca

SEQ ID NO: 176 - DNA, 23 bp, Homo sapiens
tccatccattagtcgatgatcca

SEQ ID NO: 177 - DNA, 23 bp, Homo sapiens
tccatccagcgtaagatgatcca

SEQ ID NO: 178 - DNA, 23 bp, Homo sapiens
tccatccattataagatgatcca

SEQ ID NO: 179 - RNA, 22 nt, Artificial Sequence
  hsa-miR-3191-5p
cucucuggccgucuaccuucca

SEQ ID NO: 180 - DNA, 19 bp, Artificial Sequence
  CACNA1A IRES target of miR3191-5p
gggaagaagtgtccggcca

SEQ ID NO: 181 - DNA, 76 bp, Artificial Sequence
  AAD-miR3191-5p
ggggtcacctctctggccgtctaccttccacactgacaagggccgtggggacgtagctggccagacaggtgacccc

SEQ ID NO: 182 - DNA, 56 bp, Artificial Sequence
  Synthetic primer
atgtctccgcccctgggtctccccaacaactctggccccagagtggcttacaagcg

SEQ ID NO: 183 - DNA, 56 bp, Artificial Sequence
  Synthetic primer
cgcttgtaagccactctggggccagagttgttggggagacccaggggcggagacat

SEQ ID NO: 184 - DNA, 48 bp, Artificial Sequence
  Synthetic primer
actgagcacaataacttggccaggttgttggaggccctcatgcttctc

SEQ ID NO: 185 - DNA, 48 bp, Artificial Sequence
  Synthetic primer
gagaagcatgagggcctccaacaacctggccaagttattgtgctcagt

SEQ ID NO: 186 - DNA, 29 bp, Artificial Sequence
  Synthetic primer
atcaggatccgccctcaacaccatcgtgc

SEQ ID NO: 187 - DNA, 22 bp, Artificial Sequence
  Synthetic primer
gaatctagattacttgtcatcg

SEQ ID NO: 188 - DNA, 28 bp, Artificial Sequence
  Synthetic primer
atcaggatccatgtctgcgagccaggat

SEQ ID NO: 189 - DNA, 28 bp, Artificial Sequence
  Synthetic primer
atcagggcccaggtcagcaacattgagg

SEQ ID NO: 190 - DNA, 28 bp, Artificial Sequence
  Synthetic primer
atcaggatccatgtctggtggctccgcg

SEQ ID NO: 191 - DNA, 28 bp, Artificial Sequence
  Synthetic primer
atcagggcccttaaataaggtcagccac

SEQ ID NO: 192 - DNA, 20 bp, Artificial Sequence
  Synthetic primer
gtctggggaagaagtgtccg

SEQ ID NO: 193 - DNA, 20 bp, Artificial Sequence
  Synthetic primer
gctcctcccttggcaatctt

SEQ ID NO: 194 - DNA, 20 bp, Artificial Sequence
  Synthetic primer
tttacatggtaacgcggcct

SEQ ID NO: 195 - DNA, 22 bp, Artificial Sequence
  Synthetic primer
ggtctggtataatacaccgcgc

SEQ ID NO: 196 - DNA, 22 bp, Artificial Sequence
  Synthetic primer
gcgggaaatcgtgcgtgacatt

SEQ ID NO: 197 - DNA, 24 bp, Artificial Sequence
  Synthetic primer
gatggagttgaaggtagtttcgtg

SEQ ID NO: 198 - DNA, 20 bp, Artificial Sequence
  Synthetic primer
gctacagcttcaccaccaca

SEQ ID NO: 199 - DNA, 20 bp, Artificial Sequence
  Synthetic primer
tctccagggaggaagaggat

SEQ ID NO: 200 - DNA, 17 bp, Artificial Sequence
  Synthetic primer
gctctctggccgtctac

SEQ ID NO: 201 - DNA, 26 bp, Artificial Sequence
  Synthetic primer
gtccagtttttttttttttttggaag

SEQ ID NO: 202 - DNA, 22 bp, Artificial Sequence
  Synthetic primer
cttcggcagcacatatactaaa

SEQ ID NO: 203 - DNA, 20 bp, Artificial Sequence
  Synthetic primer
aaaatatggaacgcttcacg

SEQ ID NO: 204 - DNA, 20 bp, Artificial Sequence
  Synthetic primer
tgctgactgttttccagtgc

SEQ ID NO: 205 - DNA, 20 bp, Artificial Sequence
  Synthetic primer
aaggagccgatgatgatgag

SEQ ID NO: 206 - DNA, 60 bp, Artificial Sequence
  Synthetic primer
gtattgcgtctgtacactcaccgttttggccactgactgacggtgagtgcagacgcaata

SEQ ID NO: 207 - DNA, 20 bp, Artificial Sequence
  Synthetic primer
gtacctcacccgagactcct

SEQ ID NO: 208 - DNA, 20 bp, Artificial Sequence
  Synthetic primer
cggacacttcttccccagac

SEQ ID NO: 209 - DNA, 21 bp, Artificial Sequence
  Synthetic primer
ttggtggagattatcgtggag

SEQ ID NO: 210 - DNA, 21 bp, Artificial Sequence
  Synthetic primer
tcttgcaagctgaggctctta

SEQ ID NO: 211 - DNA, 21 bp, Artificial Sequence
  Synthetic primer
cctatgaggatgtgcatgtga

SEQ ID NO: 212 - DNA, 21 bp, Artificial Sequence
  Synthetic primer
tggggtccagagtgacagata

SEQ ID NO: 213 - DNA, 21 bp, Artificial Sequence
  Synthetic primer
gaattcccaagggctaaagtg

SEQ ID NO: 214 - DNA, 21 bp, Artificial Sequence
  Synthetic primer
tttcacaccatctccacttcc

SEQ ID NO: 215 - DNA, 21 bp, Artificial Sequence
  Synthetic primer
aaggcagccctcaagttaatc

SEQ ID NO: 216 - DNA, 21 bp, Artificial Sequence
  Synthetic primer
aagtctctgatgccagacgaa

SEQ ID NO: 217 - DNA, 21 bp, Artificial Sequence
  Synthetic primer
catggaaaccagacctgagag

SEQ ID NO: 218 - DNA, 21 bp, Artificial Sequence
  Synthetic primer
acgctcacattcaagagcagt

SEQ ID NO: 219 - DNA, 21 bp, Artificial Sequence
  Synthetic primer
cgctagaactccactgattgc

SEQ ID NO: 220 - DNA, 21 bp, Artificial Sequence
  Synthetic primer
taccagctctgtctccaggaa

SEQ ID NO: 221 - DNA, 21 bp, Artificial Sequence
  Synthetic primer
tcaccaagaacaaccagttcc

SEQ ID NO: 222 - DNA, 21 bp, Artificial Sequence
  Synthetic primer
gtgagcttggagaagtcgatg

SEQ ID NO: 223 - DNA, 22 bp, Artificial Sequence
  Synthetic Primer
attgcttcccgtatggctttca

SEQ ID NO: 224 - DNA, 22 bp, Artificial Sequence
  Synthetic primer
tcagcaaacacagtgcacacca

SEQ ID NO: 225 - DNA, 22 bp, Artificial Sequence
  Synthetic primer
gggacccagggagagacguaag

SEQ ID NO: 226 - DNA, 22 bp, Artificial Sequence
  Synthetic primer
ugaagccagcucuggucugggc

SEQ ID NO: 227 - DNA, 19 bp, Artificial Sequence
  Synthetic Polynucleotide
  misc_feature: CACNA1A IRESmut
cccaacaactctggcccca

SEQ ID NO: 228 - DNA, 24 bp, Artificial Sequence
  Synthetic Polynucleotide
  misc_feature: hsa-miR-711 Target Sequence
cacatgtctccgcccctgggtctg

SEQ ID NO: 229 - DNA, 21 bp, Artificial Sequence
  Synthetic polynucleotide
  misc_feature: hsa-miR-4786-3p Target
tgtccggccagagtggcttac

What is claimed is:

1. A method of treating spinocerebellar ataxia Type 6 (SCA6) in a subject in need thereof, comprising the step of administering to the subject (i) an antisense molecule, wherein the antisense molecule comprises the sequence of SEQ ID NO: 179, (ii) a vector encoding the antisense molecule, (iii) a cell comprising the vector or antisense molecule, (iv) an extracellular vesicle comprising the antisense molecule, or (v) a combination thereof, wherein the antisense molecule binds to a portion of an IRES of a CACNA1A gene comprising the sequence of SEQ ID NO: 180, optionally, wherein the antisense molecule binds to Argonaute 4 (Ago4).

2. The method of claim 1, wherein the vector comprises a nucleotide sequence encoding the miRNA comprising the sequence of SEQ ID NO: 179.

3. The method of claim 2, wherein the nucleotide sequence comprises of SEQ ID NO: 181.

4. The method of claim 1, wherein the antisense molecule is an antisense nucleic acid analog comprising the base sequence of SEQ ID NO: 179.

5. The method of claim 1, wherein the cell or extracellular vesicle is autologous to the subject.

6. A method of treating a subject with a predisposition to spinocerebellar ataxia Type 6 (SCA6), comprising the step of administering to the subject (i) an antisense molecule, wherein the antisense molecule comprises the sequence of SEQ ID NO: 179, (ii) a vector encoding the antisense molecule, (iii) a cell comprising the vector or antisense molecule, (iv) an extracellular vesicle comprising the antisense molecule, or (v) a combination thereof, wherein the antisense molecule binds to a portion of an IRES of a CACNA1A gene comprising the sequence of SEQ ID NO: 180, optionally, wherein the antisense molecule binds to Argonaute 4 (Ago4).

7. The method of claim 6, wherein the antisense molecule is a microRNA (miRNA), a pri-miRNA, or a pre-miRNA.

8. The method of claim 6, wherein the vector comprises a nucleotide sequence encoding the miRNA comprising the sequence of SEQ ID NO: 179.

9. The method of claim 8, wherein the nucleotide sequence comprises of SEQ ID NO: 181.

10. The method of claim 6, wherein the antisense molecule is an antisense nucleic acid analog comprising the base sequence of SEQ ID NO: 179.

11. The method of claim 6, wherein the cell or extracellular vesicle is autologous to the subject.

* * * * *